United States Patent 12,648,970 (COMPOSITIONS AND METHODS OF TREATMENT COMPRISING TUMOR-TARGETING BACTERIA AND CHEMOTHERAPY OR IMMUNOTHERAPY AGENT) - sequence listing, part 3

SEQ ID NO: 5 - DNA, 4857399 bp, Salmonella enterica (residues 3,238,267-4,857,399 of 4,857,399)
ggacttggctttctgtactgcgtccatgctcagcgcacgaatagcattggcaagctctttacgtgaggacattttgactccagatcggatgttgaaaggccatgcccgtaacgacttgacgacagcgcgttttgggctacgccggaaaatttgccaacaatttaccccaagccgcgcgtcatgtacatggaacatccttttaccgcttcagaaatctccggatcatgctcgtatgttgcgcaattagctaacttgcctgccatgcttttctttatacttaacccaggcgctaattcatctgcaacgggcgcatttcaaaataatattgattcgtatggaagagaaaaatgaaaattcgcgctttactgcttgctttgggcatggcgacggtgctgaccggttgccagaatatggactctaatggactgctttcttcgggcgctgaagcttttcaggcctatacgttaagcgatgcgcaggtaaaagcgttgagcgatcaatcctgtcaagagctcgacagtaaagcgaaaatcgcgccggcgagcagcgaatacactaaacgactggcaaaaattgccgccgcgctgggggataacattaacggccagccggtgaactataaggtttacgagacgaaagacgtcaacgcgtttgccatggcgaacggttgtatccgcgtctacagcggactgatggatatgatgaccgacaacgaagttgaagccgtgatcggccatgaaatgggccatgtcgcgctgggtcatgtaaagaaagggatgcaggtcgcgctgggcactaacgccgttcgtgttgcggcggcatcggcaggaggcgtagtcggcagcctgtcgcaatcacagcttggcgatcttggcgaaaaactggtgaactcgcagttctctcagcgtcaggagtccgaagcggatgattattcttacgatctgttgcgcaaacgcggtatcagtccggcaggactcgccaccagctttgagaaactggcaaaactggaagcgggtcgtcaaagctcgatgttcgacgatcacccggcgtccgccgcacgcgcacagcatgtgcgcgatcgtatgagcgcggacgggatcaaataatccccgaacagtgccggatggcggcgtgaacgccttatccggcctacaagcatcaatcagctgtaggccggataagcgcagcgccatccggcaaaacaacttactcgcccttcttcgccgcctggatatagagcatttctaatgccagcgtcgcggccgccagagcggtgatctccgactgatcgtaagccggcgcgacttccactacatccataccgacaatgttcagatctttcagaccgcgtaccagtttaatggcgcgatcggaggtcaaaccgccgatcaccggcgtaccggtgccaggcgcaaacgccgggtccagacagtcgatatcaaaggtcagatagaccggcatatcgccgacgatctgtttcacctgagcgagaatatcatccacgccgcgatcgttgacctggcaggcatccagcacggtaaagccattgtctttgtcaaactcagtacgaataccgatctgtaccgaatgatgcggatcgatcaggccttctttcggcgcggtgtagaacatcgtgccgtgatcgaattcgcagccgttagcgtaggtatcggtatgcgcatcaaaatgtaccagcgccattttgccaaaatgtttcgcgtgggcgcgcagcagcggcagcgtgacgaagtggtcgccgccgaaagagagcatacgcttgcctgcagacagcagtttttcagcgtgcgcctgtaatttttcgctcatttcacgggcatcgccaaacgcatacaccaaatcgccgcagtccacgacgttcaggcgctcgcgcatgtcaaaattccacgggaaacggtgatgttcccaggcaaggttggtcgacacctgacggatcgccgccgggccatgacggccgccagcgcgaccggacgttgccatatcaaacggtacgccagtgatcacccagtcggcatcgctgtcatacggctggaagttcattggcagacgtaaaaaaccaaacgcattagaaaccagtgagttatcgtactgatgacctaaggtgctcatggcaaaaacctcttcttagtcaatataaaaaaaccctcccgcgtcgttaggcccgacgaggaagggtttgaatttgtttacggctcaaagtttactctgacagaccgcattattgaagtcagtttagccaggtacagtagacaacgcccgaaaaaaatatatatccagcgcaaatcagtaggctcatacgtccatcgcggtcagttaagaggccttagggatttgccgctgtaaaaactcaagcactaatgcgtaaaacagcggtgtttttcctggcgtctggaaaatggcgtgaccgctaccgggaatgagggtcatctccgcctgaggcagcagccggtacagctcggtaacttcttcaacggtgaaaaattcatcccggtcgccgtccagtaatagcacaggaatgtggatttttttcacctcttcttccgccagcgatgtgggcgttgtccacattggccagacacctttgaggaacgtgcgccagtagtctttttgctctggatgatgcatgttctgataaaatttaaccatcccgggcgcatccgaagccattttatccagatcgcgatccgtcaattgcccctgaggcattcctttaccataaaaaatttccatcccctgcatgtaatgggtcgtagcaaagcgatgcgttgcgccgccgacgatagcagcgcgcgctagatccgggtatcggctggttaacttcagaacgaccatgccgccatcgctgtaacccatcaccagcggtttttccagcttcagcgctttaacaaaagccgccatatcttccgtcatcagatcatagctaaacgttccttgcgggttattggttaatccatgtccacgactgtccggcatgatgacgcgaaaatatcgagatgcctctttcgctaatccctgccaacttttcgccgtcagaccaccaccgtgaatcaacagcagcggaggcccctcgccctcttcaacgtaatgaattttgataccattcgcttccacaaatttatctttgtccatcgttgttgctgaagcatttattaaaaatataatattgataataaaaataaatgctaatttaaaaatatgattcataacacctcgccaatcactttccgtgtaaaagaccatattattcagattgaacaaaaataacatcaaaatcgatttgtatcattttcacttatttaccggggagaccccgcatcctctttttacagaacgtaaaaagcctttccgcgattaaccccaacgcgaaaaggctctgaagtcagaaaagtgccaccttattcattctggctgtaattcaggatgacttgaaggtctcttcctgaattgcatttagcgctttctttattccttcgcctgacaagactagcttgactcgctaaatgccgtggccggaattttcacaatcgcttttttaaccggcgcaggtttaccacgcgtacaaagcggacggtggacctggttgggataaaaaagcgcgaaatcgccaggatttaatgtaacgaactgctcattagcgacacattcaggaaagatgatgtcatcaggaagatgctcaagctcctttatcctggtatcaattttgttggaatagccaatctcctcataaccgcttagtaaaatctgaacatcgatatattttttatgaagttcagctttgcggtttaacgaagagtgtgtttctccttcgcttatcataagaaatgactccgggaaagaaagttcatatctaccagcaggctgatcttcagctatcttcaccgcttcgatgataagttttttaataatgtggttaacgtaaggtaataaagtaagctgctctatatttccatatagcatactatagttatcctaaataatggtcgtgattataattatcagccaatcaggtactggtaaataccttcagccacaggaataccttcttttaaacatttttctttataggcgatttgcggatcgtttggcgccagcactttatcaacaccgggcatcggttttacagcccttagctcattgaccattgtgctcattattgaggaaaacagcggattgcccaacatctgcggatcaataacgataaccagactcgctaacttgcgcatcttgtcatagtcgccatacatccgaacaatatggttgctaaagtttgcccccatcaggacgcccgtgagcgcatcaatcgccagggcaataccagaacctttgtgtccgccaaagggcagcagattttcaattttatgcggatcggtagtgatatgtccctctttatccagcgccagaccatgacctattggtttcccggtttctttggcgtgcagaattttaccaaacgcaatggcgctggtcgccatatcgacgatcatcggatggctgtctttaacggggaagccgaaggcgattgggttagtccccagaaagcgctccgcgccgccatacggcgcaacacaggtatccgttcgcgtcatggcgatagccaccattccctggcttgtcgcctgctcaatgaaccacgagagcgcgccgcagtgggacgtatttttgacgctgacgaaacccagccccgtctctctcgccagactaatagcgtgatctgtcgcctttatcagcgcgcagtgtcccattccatcatcagagtccagaatagcgactgaaggcgaaatctgttcgatgctgaatgttgcttttggattgagcccgcctgcgttcaggcgggtacaatagtgctctacgcgaataacgccgtgggagtgaacgccggtaatatcggcatgaaccaaaacgtcggctacctgctgcgccgtttgcgcgtcaagacccgcctgggtgagtttattaaacgccagcgctttcaattcattttctttgactaatattgttgacataactatcccgctattaaaatttgataacgcctttaaccaattttttgttttctaccacgttcttctggtactggttgccgaacgtatagaaatcgaattcctggtttttcatcattgtttcgctaatagcgccctgagccattagctcaatgacacattcgaagtcttcccgcgtcgcgttacggctgctcaatagcgtggtctcttttttatggaaggtcggatcgtcaatgacgagctcgccgatatacagcccgatgaagacgatttttccgccgtgacgaatcagatcgacagcgcggctcatggaggatttattgccggtggcatcaagcacagtgccggctaattcaccggagaaacaggctttcagcgcatcaatatagtcgtctgacgacggatcgagcgttgcaacgcctaccttttcggcgaccagacgacggcgttcggcgtcaatatcagctaccgcgacgcgagcgcctttggcttttgctatcgcggcggcggccagcccaatcggcccggcgccgaccaccacaatgttttgctgcggcttcacgtcagcgcggcgtactgcatgggcgctgatggcgaaacactcaaccagcgcgcccgcgctgtcagtgaggttatccgacagttcaaccagattttgttcacgaacggccagatattcgctaaagccgccgtcctggtgaacaccatacagcgagacgttctcacagcagttggtttttccttcccggcaggctgcgcaagcgccgcaaggaatacagggaataacgctatagcgttggccgaccttcgccgtgctgcacgatttacctaacatttcagccacgccgcaaatttcatgacccagcacgcgcggataggcaaaaaagggctggcgaccggcaaacgcatggatatcggtgccgcaaataccaaccgctttaatttttaacagtacttcatcgtcttttaaatgaggaatatccctttcaatgtattcgatatttcccggattattacagataagcgttttcatacttaaccctttgaagataaacggtgaatggtggccgtgacgccatgtaattcaatatggttaaaggcctgctgaatgttgtttaaaaagtctgcgttgtcgctggccagcgttccaaagatgctatttatctgcagcaaagacagcgcttgttcccatcgcgtgtttttatttttaatagccgcattgaaggtatcattgagcgggtcggccacgctctgcccctgagagagcgtattaatgacgtaatggagccagcccgcaatcagcgtcgctaacgccctgcccttaacaccgcgcgcctggagcgtcagataaggatcgacggcccgctgaggcagcttctgagaaccgtccatcgcaatctgtccggtcttatgtttaatattcgggttgctgaatcgatcaatgagcaactgcgcatattgatgtacatctaccgccaaattcgggcgcagcgattttgcctgctcttccgtcattaaatgatgtacggcggttttaaaagcgtcgtcttccatgcactgatagataaactcatatccggccaggctgccgttataggcgagaaacgaatggctgccattcagcatacgaagtttcatttcttcatagggaagcacgtccgagacgaacatcgcccctgctttatcccagtcaggacgaccggcaacgaaattatcttcgataacccactgacggaaatcctcgcatacgatgccgcagggatcggcaaaaccgatctggtctttaatcatgtcaaattgctctggcgtcattgccggcacgatgcgatcgaccatggtgccaggaaaggtgacatgcttcgctatccaggccgccagttgcggatcgagattatcggcaaacgtaacgatcgccgttttggtcaaatgaccgttttccggaatgttatcgcacgacagtacactaaacgggggaagcccttgctggcggcgtatccgtagcgcttcgacgatcagtccgagtgctgaccggggatgttcaggatcggcaagatcgtgtttgatgagcggatggctgagatcgagcgttctggaccgtggatcggtgcagtaacctttttccgttatcgtcaacgaaacaatttttacctgcggctcagtcagcttctcgatcgccgcctgaatacctgacttcggcgtatgcaacgcgccggtgatggtacgaaccaggcgactattgatggcgctggctgacgtttccaccactgaaaacagcccctgttgcgcatttagcgcatccaccagctccgcatcgccgaacagattcagttcaaaaatcccccagcggttgccggttatctcattcgtgagatcgttataaacagcctgatgaccacggtgaaaggcgccaaatccaatatgtacgatgttggcttccattccctgacgtgaataagtcgttttgaattggtgccttgcggcgtctaactggcgagctatggtgtccatgaatttttcccactcctgttttgtttaccaattctgcttaaacaccataccaaaatccgtgaatatgatcacactcatggcaccagattctttaccatggtatgctgactaatagccaatgaataaaaataatttatttatcaattagttataaaaagcacttctcaggataaattttacgattcacaaaagcgtgattttgattagaaaaatcggccacaaattggcataccacccatacaacccgtaatcattaaaccacatgaaaaacaatatcttattgaataacacgcccgctgcaagtgtatatgtcacgcatgattggttcaataatcacccgaaatacagcaaaccaaacctgataatttgtctagtgaattaatgaactcaatttattatcagcatcaacattaacctaagaacatcagttacggttttgatcatccgggtcgctgctaaagcgatgaggagtgagccgcctttagacgtaattggcaaattaatccattgatttaaaacaggaaaaaattgatgaagacgcggattaggcacgttgaaacaaagctttcaaagcccctctggccgaggtcttagttgacgtgaaacatggcataatagccatttcgaactggtaaccacgacgattacgctggaagacggttcaactggcaccggatatacctataccggcggaaagggagggtatgcaattaaagcgatgatcgaccacgatcttgccccggtactgtcagggaaagaggcgctgcgattgacgatatctatgactttatggaatagcatattcactatgtgggttgcggaggcatcgcgtcgtttgcgatgtctgcgatgtctgcgatgtctgcgatgtctgcggtggatatcgccctttgggatttgaaaggcaaacgtgaaaaactgccgctgtggaaaatggctggttgaaggcggcgcgtctgtcgacgaatagcggtcgtttggtatgctcgctcggtatgcaggaattacacgtcagactggtttccgcattcgagactggctgactggaggttcacagtttcccaatcgatcaatataccaaacatccgctggtggtcgacaattatcgcgccgtggcaccggacacctacggcattggcgtagagtttgactgggataagctgagcgtttacgaagcctgattccctctctccgggcttgtttttggcggcaggcccggttaatcgctgacaaaaatgtcatccgcctgaaaatagccgtcaggtggcgaagaaaaaatcatcaaaatcttccagcgaatcatcctgttggaagatttttaccagctcatttttactgttttcaagatgggtccacgaagcctgtctggcctgctcagcatcgcgtttttgcaatgcaaggaagatactacggtgatcttccacccatttcattcttaactctttcttatgtaaatacttatagtttaactgcttccagcgcggattttcggtcctgacagcccgccacagctcggcagattgtttcattaatacacgattttgcgtggattccgcgatgatattgtggaactggcgatccagttcttcaaatttgtcgctgtcgccgccaatctgcttttcctgctgctcaataatacgtttaagctgcttaagttcattaaatctgatttgcgtagcggcaaaaccggtgatgttactttcgatgacctgccgggcctgtagcaattcaaaggggccaatgtctgagtaaggcaagagcgctttttgattgattttttccagactatcaataaagtaagtgcctgcgccttgcttaacctctaccactcccttcagctcaagcataataatcgcctcacgaatcgtcgtgcggctggtttgaaaacgctcgctgagttctctctccgccggaagtcgctcgccagctttaaatacccctgaatagagtagttcttctatttgcagccctatatcaaaatagcgccgcttggttaaaatttgttccatgcacatacctatgtagacagcaattgctccacttgagggtagtgtaaacaaatcctaatgtttatggtaaacaatttccctgccagagagtggtcgtttctttcccgcaacctacggctatgcgcgtcacacagtccttccccaccagactcggcaggaaaggtgctgattcccataacgcatatttgacgtttgatgccgggtttatttgcggcagggcggcggcgcatacccgttgttgtccgccgggaaagcctgcgaggaacaaggcggtagcgtatttgttgctttaccctgcaatgcaaaagcggcaaagccgatgacgccgatgttgcgtacatcgccctgcgcggagtgggccgcataagcgtcagctacgtcggcgaactggaatgccgcctcagtgtgtttatctttgcgaaaccctttaatcgccagtgaatcgccggcgttaacaatatagccatgatgattcagcgagcctgcttttccgttcaacacgtccaggccatcaaccgttgcgacgatttcgtaattggtatcatgactgtaattacgaatatataactgatagttcatccctgatcttgcaggaatactatattgccattgtcccattgatgcgttgtagcgacgagtaattggaatcgaattaaaattagcgtcgcgcacagcatattcaagatcgctgatacgtatactataaactttatcgtaacctgacggatattgagtggagtaatttattatcaccatttcggcaggttctcgatcggcacgttctaccgaaacgctttgtaccgatgaatgcacgtcgccgccccaagcggtgccgacgtcggatgaagagccattattagattgcattccgctggaacaaccgcctaacagcaaaaacaagccaacaatgacggcattaaatttaaatttgctcatactcacacccctttttaattattagggggattgtaggcccataagattacatagagaagcgacgcgctgataattaagaatttataaaatataaaagggtcgatttaaataattaaatcgacccacaagtggaatactcttaattactcatcttcaagataagtataaccgtacagtcccgcttcaaattcctcaaggaactgctgctgcaacgcatcgtccagatccgtctgttttacctggtcgcggaaatgcgttaacagcgttttcggatccagttgcacatattgcagcatatccgcaacggtatcgccttcgtccgacagttcaacctcgacgctaccatccgggaagacaaacacgtcaaccgcttcagtatcgccaaacaggttgtgcatgttaccgaggatctcctgataggcgccgaccataaagaagccgagcatcggtggattctctggatcgtattccggcatcggcatcgtcgtggcgataccgtcgccatcgatatagtggtcgatagcgccatcggaatcacaggtaatatccagcagcacggcacgacgttccggtacctgatctaacccttccagcggcagcaccgggaagagctgatcgattccccacgcgtccggcattgactggaacagcgagaagttgacgtacattttgtccgccattcgctcttgcagttcgtcgataatcggacgatgcgcacggttttgcgggtccagttgcttctgcacttcatggcacatgctgagataaagttgctccgcccaggcgcgctcctgcaaactaaacgcgccggaagagtagccgatatgaatatcgtgcagatccatttggctatcatgcagccattcacgcagcgagcggcgagtgccaggcttatgcatctcctgccaggtttcccacagattttgcagcgcacgcggcgcatcttcagcaggggcagtcggatccgtgtattcgttacgctccacgccgataatgttagagaccagtaccgtatggtgcgcagtgacggcgcggccagactcggtaatcaccgtcggatgcggtaaaccatgctcttcgcaggcatcgccaatcgcccagatgatgttattggcatattcgttcaggccatagttcaccgaacagtcggactgcgagcgggtaccttcataatccacgcccagaccgccgcccacgtcgaagcactggatattcacgcccagcttatgcagctcaacatagaaacgcgcggactcgcgcacgccggtcgcgatatcgcgaatgttcgccatctgcgatcccaggtggaagtgcaacagttgcagactgtccagacgcccggcgtcacgcagggtctccaccagttgcagcacctgcgtcgccgccaggccgaattttgatttttcgccgccggaggattgccacttaccggacccctgagaggccagacgcgcacgtacgcccagacgaggaaccacgttcaggcgctcggcttcttccagcacaatcgcgatttcagacatcttttcgatgaccagataaaccttatggcccatcttctcgccaatcaacgccagccgaatgtattcacggtctttataaccattacagacgattacgctacgggtcatgccggcatgcgccagcaccgccatcaattccgcttttgaccccgcttccagccccaacggttcaccggaatggataagggactcgatcacgcggcgatgctgattgaccttaatcggataaacgaggaagtagtcgccgttataaccgtaagattcacgcgcacgcttaaacgccgcgttaattgaacgcaaacggtgttgcaggatctgcgggaagcaaaacagcgccggcagacgctgaccttgcgcttcgcgcgctttcaccagtttggcaagatcgacacgcgcttccggtacgtcgggatcggggcatacgctaatatggcccagctcgttgacgtcgtagtagttattgccccaccaggcaatattgtaagtgcgcagcatcttgctggcttcctgggagctcattgcaacctcctgcatggagcgtagtacaccctgttcgcctgctgacgaaggcgaacccatagacatgtcgtcagacatagcgaacctcaatttttattagcaagtgtaaaacagttgactactatcgcaatccgaagacgcgataacaacccatagacaagcggattttccagcagatagcgctgatgctccgcctgcgcgaccggtttctttttcatatcattgtaaacacgtaaccgaactcacagataacggttcggcgaaaccacgagaaaactcttgcgttaacaagagcgcccttgttcagtcttcagcgccattgccggctctggaatcctgagaagcgccgagatgggtataacatcggcaggtatgcaaagcagagatgcagattgcgggggacatgcgcgcaccagaacgatgcgacagattcagcagaatacaacggttcattatctcgtatcacctccacggccgcctcgtaagacgaacccacaagccaaagcaacgttttaacccggctggaagtggcgacacgaagaaaacgtcgtgtgcttttgtatgagccgcgcgtcgcgttttatacccagaacgcagaaaaaaagcaaagcataaatgcgcataatgtcagcattatcagaaacgtttaccgcctgattttgaccgacattgcgacggccttcaaaaaaagctggaaattgggcgaagaagtgacctaaaatagccgtccagatgttaatccatccatactgattaacactcagactgccagtgtcagcaaccttcagactcatggtagaatcttctgtcatgactattccgcacaacagtttgagctaactaaattctccttaggtgaaattaaatatggcaaaacacctttttacgtctgagtccgtatcagaagggcatcctgacaaaatcgcagaccaaatctctgatgccgtgttggacgctatcctgcaacaggatccgaaagcacgcgtcgcctgtgaaacctacgttaaaaccggcatggttttagttggcggtgagatcaccaccagcgcctgggtcgatatcgaagagattacccgtaatacggtgcgcgaaattggctatgtgcattccgacatgggctttgacgccaactcttgcgcggtactgagcgcaattggcaaacagtctccggatatcaaccagggcgttgaccgcgcagacccgctggaacaaggcgcgggcgaccagggcctgatgtttggctacgcgacaaatgaaaccgacgtactgatgcctgcgccaatcacctacgcgcaccgtctggtacagcgtcaggctgaagtgcgtaaaaatggcaccctgccatggttgcgtccggatgcaaaaagccaggtcactttccagtatgacgacggcaaaatcgtcggtatcgacgccgtggttctctctacgcagcacgcagaagatatcgaccaaaaatcgctgcaagaagcggtgatggaagagatcatcaaacccattctgccgtctgaatggttaaatacgtccactaagttttttatcaacccaaccgggcgttttgttatcggcggcccgatgggcgattgcggtctgaccggtcgtaagatcatcgttgatacctacggcggtatggcgcgtcacggcggcggcgccttctccggtaaagatccgtctaaagttgaccgttctgcagcttacgctgcgcgttatgtcgcgaaaaacatcgtggcggcaggtctggcggatcgctgtgaaatccaggtctcctacgctatcggcgtagcggagccgacgtccatcatggtggaaacgttcggtactgaaaaagtgcctgctgaacagttgattctgctggtgcgcgaattcttcgacctgcgcccgtacggcttgattcagatgctggatctgctgcacccgatctacaaagaaactgcggcttacggccacttcggtcgcgaaaacttcccatgggaaaaaaccgacaaagcgcaactgctgcgcgatgctgccggtctgaaataatcgcccgcgcctgacgctgtttttcagtcagggaaaccataccgtacttatcaaggccagcgctctgctggcctttatcattgctgatacacgcaacgttatcagatattccagcgtgaatttatactgacctttttgtgatgcgcagcacaatccactctcccctttcgtttcttcgactacactttttatcattcagtttcagtcatcatgaaagcggttacattcattttcattaagaactgactacatcactatcggtatgctaattctgcgatgaaaatattacataatttttcaactttgtctaaataccaggcgattgatatggttataagattattaaaactattatttttcagataattaaataatcaccgagataaatagcagtgtaaacgattacaccattgtgattagcctcacatctttttacggcgtactcacctactcttaacatcgataaaattgctaacccaaccggagggcataatgcctgacaataaaaaacaagggcgttccaacaaggccatgacattttttgtctgctttcttgcagccctggcaggattactttttggcctggatatcggcgttatcgccggtgctttacccttcattaccgacgagtttcagattaccgcacacactcaggaatgggtggtcagctccatgatgtttggcgcggccgtcggcgctgtcggcagcggctggctctcctttaagctgggtcgtaaaaaaagcctgatgatcggcgctatcctgttcgtcgccggttcgctgttctccgctgcggcgcctaacgttgaagtcctgattatttctcgcgtgctgctgggtctggccgtcggcgtcgcttcctacactgcaccgttgtacctgtccgagatcgcgccggaaaaaattcgcggcagtatgatctcaatgtaccaactcatgatcaccatcgggattctgggcgcttatctgtccgataccgcgttcagctacagcggcgcatggcgctggatgctcggcgtgatcatcatcccggctattctgctgctgatcggcgtcttcttcctgccggacagcccgcgctggtttgcggcgaaacgccgtttccatgatgctgaacgcgtcctgttgcgcctgcgtgacaccagtgcggaagcaaaacgtgagctcgatgaaattcgcgaaagtttgcaggttaaacagagcggttgggcgctgttcaaagagaacagcaacttccgccgcgccgtgtttcttggcattttgttgcaggtcatgcagcaatttaccgggatgaacgtcatcatgtattacgcgccgaaaatcttcgaactggcggggtacacgaataccacggagcagatgtggggcaccgttattgttggtctgactaacgtgctggcaaccttcatcgctatcggcctggttgaccgctggggccgcaagccgaccctgacgctgggcttcctggtcatggcgattggtatggggattctgggtacgatgatgcacatcggcatccattcgccgtctgcgcaatacttcgctatcgctatgctgctgatgttcatcattggatttgcgatgagcgctggtccgctgatttgggtactgtgctccgaaatccagccgctgaaaggccgcgatttcggcatcacctgctccaccgcgaccaactggatcgccaatatgatcgtcggcgcaacgttcctgaccatgctgaacaatctgggtaacgccaacaccttctgggtctatgcgggcctgaacgtactgtttatcctgctgaccctgtggctggtgccggaaaccaaacacgtttcgctggaacacattgaacgtaacctgatgaaaggtcgtaaactgcgcgaaatcggcgcccacgactaatccctccacgcttcctcctgccacaggaggaagcgtttttcttgcagtccctcttccgtcgcactattctctgccgctatgaaaacccctcgtctccctatcgctatccagcaggccgtgatgcgtcgtctgcgggaaaatctcgcccaggcgaacctcaagctcgatagacattatccggagccgaaactggtgtatacgcaacgcggcacctcggcgggcaccgcctggctggagagctacgaaatccgcctcaacccggtgttactgctggaaaacatcgacacctttatagcagaggtcgtgccgcatgaactggcgcatctgttggtgtggaagcacttcggacgcaaggctccgcatggcaaggaatggaagtggatgatggaaagcgtgctgggcgttccggccagacgtactcatcaatttgcgctgcaatccgtacggcgcaacacctttccctaccattgccaatgccagcaacatcaactcaccgtccgccgtcataaccgcgtagtacgcggcgaagcggtttatcgttgcgttcactgcggtgaaccactggtcgccgggtagttcccgaaacgtccgggaactttcctgagcggactgattgcatacagacacaactttcgttacgttgcgggctcgttttgctatggagtgtgcaatgtaccgtaatttttcttttgccgctgcgttgctggccgcagcgttttcaggccaggccctggccgatggcattaacaatttttctcaggccaaagcggcgagcgtcaaagtcaatgctgacgcgcccggcagcttttactgcgggtgccaaatccgctggcagggtaaaaaaggcgtcgtagacctggagtcctgtggctataaggtgcgtaaaaacgagaatcgcgccagacgcattgagtgggagcacgttgtccccgcctggcaattcggtcatcagcgccagtgctggcaggacggcgggcgaaaaaactgcgctaaagacccggtctaccgcaaaatggaaagcgatatgcataacctgcaacccgcgattggcgaagtgaatggcgatcgcggcaactttatgtatagccagtggaacggcggcgaaggtcagtacgggcaatgcgccatgaaagtggattttaaagcgaaaatcgccgagccgcccgcccgcgcccgtggcgcaatcgcccgcatttatttttatatgcgcgaccaataccaactgaaactttcccgccaacaaacgcagctttttaacgtctgggataagcagtaccccgttaccgcctgggagtgcgagcgcgatgcgcgtatcgcgaaggtccagggtaatcataatccctatgtgcaacgcgcttgccaggcgcgaaagagctaacctacactagcgggattcttgttaacccatgccctggatagccaaacgccggggccatgacgcggatttttttattatgcgtattccccgcatttatcaccctgaattgttgacgtccggtacgcagatttcgttatgcgaagatgcggccaaccatattggtcgtgtacttcgcatgggaccgggacaagcgctacagctgtttgacggcagcaatcaggtattcgatgctgaaatcattagcgccagtaagaaaagcgttgaagtgcaagtgatgaaaggcgaaatcgacgatcgtgaatcgccgctgcatatccatctgggccaggtgatgtcgcgcggtgaaaaaatggaatttactatccagaaatcgatcgaactgggtgtaagcctcattacgccactgttctctgagcgctgcggcgttaaactggatagtgaacgtctgaacaaaaagcgccagcagtggcagaagatcgccatcgccgcctgcgaacaatgcgggcgtaaccgggtgccggaaattcgcccgccgatggcgctggaagcctggtgcgccgagcaagattccgggctgaagctcaatcttcatccgcgcgcccatgccagcatcaacactctgccgctgccggttgaacgcgtccgactgctgatcggcccggaaggcgggctgtcggcggacgaaatcgcgatgaccgcgcgctatcagtttactgatattctgttaggacctcgcgttctgcgtactgagacaaccgcgctcaccgccattaccgcgctacaggtgcgttttggcgacttaggatgaagcgttaacggagaaaataatgatcaagctcggcatcgtgatggaccccatcgcacacatcaacatcaagaaagacaccagtttcgctatgctgctggaagcccaacgtcgtggttatgaacttcattatatggagatggccgacctttatctgattaacggcgaagcccgcgcccgcacgcgaacgttgagcgtggagcaaaattacgataaatggtacgagttcggcagcgagcaggagattaaactcgccgatctggacgtcattttgatgcgcaaagatccgccgtttgataccgagtttatttatgcgacctatattctggaacgcgctgaagaagaagggacgctgatcgtcaacaaaccgcaaagcctgcgcgactgtaatgaaaaactgtatactgcctggtttgccgacctgaccccggaaacgctggtaacgcgcaataaagcgcagctcaaagcattttgggaaaagcacggcgatatcattatgaaaccgctggacggtatgggcggcgcgtccattttccgcgttaaggaaggcgatcctaacataggcgttattgccgaaacgctgaccgagctgggcaaccgctactgcatggcgcagaactatctgcccgctatcaaagatggcgataagcgcgtcctggtcgtcgacggcgagccagtgccttactgcctggcgcgtattccgcagggcggcgaaacccgcggcaacctggcggctggtggtcgcggcgaaccccgtccgttgagcgaaagcgactgggaaatcgcccgccgcgttgggccgacgcttaaagccaaagggcttattttcgtcggtctggatattatcggcgaccgcttaacggaaattaacgtgaccagcccaacctgcgtgcgtgaaattgaagcggaatacccgatctctatcaccgggatgttgatggacgccatcgaagcgcgtctggcgaagtaaaggtttattgcccggtggcgtgcgcttaccgggcctgagcaattacgccgccccggtcggataaggcggcgcatcagcatcgccatccggcaatctattgcccgataaggcagccgtcctttggcaaaagacggcttatatgagtgacaaccgtccgctttccccacatactgaacgctgtcgtttttttgaaccaggaaacagaacctctgacaatgaatttacagcatcactttcttattgccatgcctgcgctccaggacccgattttccgccgttccgtggtgtatatttgcgagcacaaccaggacggcgctatggggattattgttaataagcctttggaaaatctgcaaattgaagggattctggaaaaactaaaaattacgccggaaccgcgcgattcggcaattcgtcttgataaagccgtgatgctcggcggcccgctggcggaagatcgcggatttattctccatactccgccgtcacgtttcgcctccagcattcgtatctcagacaataccgtgattaccacctcccgcgatgtgctggaaacgttaggtacccaacaacagccttccgatgtgctggtcgcgctgggctacgcctcctgggataaaggccagcttgaacaagagttgcttgataacgcctggcttaccgcgcccgccgatctcaatattttgttcaaaacgcccattgccgagcgctggcgcgaagcggcaaaacttattggcattgatattctgaccatgcctggcgttgcggggcacgcctgatgagcggcaccttactggcctttgacttcggcacaaaaagcatcggcgttgcaataggacaacgcattaccggcaccgcccgtccgcttccggcaatcaaagcacaggacggcacgcccgactggacgctcattgaacgtttgctgaaagagtggcagccggacgaaattattgtcgggctaccgctcaatatggatggcactgaacagccgctgacggcgcgcgcacgtaaattcgccaaccgtattcatgggcgtttcggggtaactgtcacgctgcacgatgaacgactcagcaccgttgaagcacgctccggtctgtttgaacgaggtgggtatcgcgcgctgaacaaaggcaaagtggactcggcctccgccgtgattatcctcgaaagctattttgaacaggggtattaaagccgtttttgtcagcaggcgggtaacgcggtcacggttgccaggcttactgggcaataagctggtttagtgccttcagcgcctgtaaacgcgcagccgcctccgcctcatcaatccgccacattcccgcaaaggccagcgctgcggcgtgcttgcctagcggttgcgccatagaaacttcaccatcagcgtgatgccacagtacgtatccccgctggcgctgctgcgccacatgcggcgccagattacgccattgctccggagtaaaacgctgcattagcgcctcatcgctttctgccgccagtaacgccaccccaggtaccgactgccaggcagggtacatgcgaaaccccgccagcgcctgacttccctgcgaacccggcgtagagtgataaatatagataatctggtcttcccatagcacgcctaatgccaccacgatgtctttgggcgcatggcgctcaaggataggcaacgcatgggagaacagcgctgaaccgcgaatcgcctgcgccgccaaagcatgaatgcctggcccgggtaaatagcgtcggtgctcatcctgcatcgtgagtccaatagaggccatcgtcattaacaggcgattaacgcgcgtggtattaatatccatcagccgggcaagctcgcgacatccgatagcacggtcgctggagaccagatattgcagacagcgaatgccatctatcaggctttgattcggttgtgatgacatcgttaaatggcttcgctgtggttttaacaaagctgcgattttaacgccggttcgccaggatacaagcctgcatgccgttcaatccaccgcgccagtcaacactttacaacccccctacgccgccatcttcgctacagtcgtccctgcgcctgacgccattgcgcgctctgggcgaatgtcatcatcccctgctgctgcccggtttgtatcacgtgggccaactgatggagtttgccttcacggatcaaattccctgtggctggcgtattaatcagtaattcaaacaacgccacgcgcccatcctgtctgtcgacctccagtttttgtgatagtacggcgcgcagactacccgccagttggctgcgtaccggttctttttcctgcgccggaaaactatccactaatctttccaccgcctgcgccgcaccgcgagtatgcagggttgccagtaccagatgccccgtttccgccgccgtcagcgccaggcgaatggtctcgctgtcacgcagctctcccagcaaaatgacatcaggatcttcacgtaacgctgcgcgcagcccggcggcaaaagtggcgcaatgctggccgatttcccgctgctgtatcaggcaacgcttgctggtgtaacggtactcaataggatcttccagcgtcaggatgtgtttatcggcatgttgattaagatatcccaccatcgccgccagcgtggtggacttcccgcagccagtagcgccagtgaccagaatcagtccgttctcgctggcaagcagtgcgggtactatcggcggcgtctggattttcgccagatcaggacagcgctcgggcaatagccgtagcgccagcgacgttccctgttgatgtgtgaacgcactggcgcgcaggcgccgcgtgccagacagcgagacggcgaaatcaagctggccgtgcgttcgccactgatattgttgcgcatcattaagccaatcaagcagaagcctgtcgacatcaggcgcggtaaaaggcgcgttctccatgcgtccttgtttgcgccatcgcgcaggccaggcgttacacaggtgtagatccgagacgttatgctttacactaagcgtcacaatttcttccatattcatataaacatcctcggaaaatgaacgatatcgcgcataacctggcatacatccgggacaaaatctccgccgcggcgacgcgttgcggccgctcttcagaagaagttacgttgcttgcagtgagtaaaaccaaacctgcgagcgacatcgcagaagccattgccgccggacaacgggcatttggtgaaaattatgtacaagagggggtggaaaaaatccgccactttcaggaagcgaaagtggaaggcctgcactggcactttattggccctttacagtccaacaaaagtcggctggtggccgagcattttgactggtgtcataccatcgatcgcttgcgtatcgcctcgcggctgagcgaacagcgtccggataatctgccggcgctaaatgttctgatccaaattaatatcagcgatgaaaacagcaaatcaggcattccgctggcggaactggatgagctggccgctgcggtggctacactgccgcgtctgcggcttcgcggactgatggcgatcccggctccagagtcagattatgtaaggcagtttgaagtcgcacgtcaaatggctgtagcatttgccgggctgaaagcgcgctaccctgacgttgataccttatctctgggtatgagcgacgatatggaagccgcgattgcggcaggtagcacaatggtgcgcatcggcaccgctatctttggtgctcgtgattacacaaaaaattaaggaaaactgaggaacgccatgaatacgttgaccttcctgctctcaacggtaattgagctgtataccatggtgctattattgcgcgtgtggatgcagtgggcccgctgtgacttttacaaccctttttcccagttcgtggtgaaaattacgcagcccatcatcggaccgctgcgtcgtattatcccgccaatggggccgattgacagcgcttccctgctggtggcgtttattcttagcgttattaaggcgatagtgctgtttaaggtaattacgtttcaggcgattatctggattgccgcggtgcttatcttgcttaaaacaatcggcctgctgatcttctgggtgctgctggtcatggctatcatgagctgggtgagccagggtcgtagcccgattgaatatgtattgattcagcttgccgagccgctgctcagcccgattcgccgtatactgcctgcgatgggcggcatcgacttctcgccgatggttctggtgctgctgctgtatgtcgttaatatggggatcgctgaagtcttacaagcgacaggcaacatgttgctgccggggctgtggatggcgttatgagtgctgtgactcgctgcgaagacggtctggtgttacggctttatattcagccgaaagccagccgcgatagtattgtgggtttacatggcgacgaggtgaaaatcgccattaccgccccaccggttgacggtcaggcaaacagccatctgaccaagtttctcggtaaacagtttcgcgtggcgaaaagtcagatcgtcatcgaaaaaggcgagctgggccgtcacaaacaggtaaaaattattcacccgcaacagatcccgccggaaattgcggcgttaactgagtaggtactccatgcaaaaagttgttctcgcaaccggcaacgccggtaaagtgcgcgagctcgcgtcgctgttaagcgattttgggcttgatgtggtagcgcaaacggaactgggcgtcgattccgcggaagaaaccggcctgacgtttattgaaaacgcgattctcaaagcgcgccatgccgccaaaatgaccggcctgcccgccattgccgatgactccggtctggccgttgacgttttaggcggcgcgccgggtatctattccgcgcgctattctggcgaaaacgcgacagatcagcaaaatctggaaaaactgctgcatactctacgggatgttccggacgacaaacgccaggcgcgattccattgtgtactggtttatttgcgtcatgcggaagatcccacaccgatagtctgtcacggtagctggcctggcgtcattactcgccaggcggccggaaatggcggatttggctatgatcccattttcttcgtaccgtctgaaggcaaaaccgccgcagaactgacccgtgaagaaaaaagcgcgatttcccaccgtggacaagcgctcaagctgctgctggatgcgttacgcaatggctaaactaccgccgctcagtctttatattcatattccctggtgtgtacaaaaatgtccatattgcgacttcaattcccatgcgttgaagggcgaggtgccacatgacgactacgtccagcatctgttaaacgatctggatgccgacgtcgcttgggcgcaagggcgtgaagtaaagaccatttttattggcggcggtacgccaagcctgctttccgggccggcgatgcaaacgctgctggacggcgtgcgtgcgcgcctgaatctggcggcggatgcggaaattactatggaagcgaaccccggcacggtcgaagccgaccgcttcatcgactatcagcgcgccggcgtaaaccggatctccattggcgtgcagagctttagtgagcctaagctgaaacgtcttggccgtattcacggtccacaagaggcgaagcgggcagcaagactggcaaatgggcttgggctacgcagctttaacctcgacttgatgcatggattgccggaccaaacgctggaagaggcgctgaacgatttgcgacaggcaattgcgcttaatccgccgcatctctcatggtatcaattgacgattgaacccaacactctgttcggttcgcgtccgccggttttaccggacgatgacgctctgtgggatatctttgagcagggccaccagttattaaccgccgcgggctatcagcaatacgaaacgtcggcctatgccaaacccggttatcagtgccagcataatctgaactactggcgctttggcgactatctggggattggctgcggcgcccacggtaaagtcaccttcccggacggcaggatcctgcgcaccaccaaaacccgtcacccacgcggttatatgcagggacgttacctggaaagccagcgtgacgtgagtgatgacgataaaccctttgaattctttatgaaccgttttcggttgctggagcgcgcgcctcgcgccgaatttgtcgattataccgggcttacggaagcggttattcgtcagccaatcgacgaggctattgcccagggctacctgaccgaatgcgagcaatactggcagattacccggcacggtaaactgtttttaaactctcttcttgagttgtttctcgcggaataacaaggataagcctgtcgcgccagcgggtaaaatacctgatggcgcgacgcttaccgacctgtggcggttaatgcgccgccggcaaacgcattatttaataacccctttacgacgcaaatcgtccgtatcttttttccagcgctcgtaaccgtcattaatatccataattttcacacggatatcactctgttgcatctgaagtttctgtaccgctatattcagcggatattgccctttctctaacgttatccagtcattctgcgcttttcgacgcagctcttctgatttcaaaaatacctgccgccgttgctcgtgtatgtctaaatctcttttctgctgaatagccgcttcattgcacggctcactctgcttacggcacgcgtctaatgccggttgatagacctctttttcgtatttctcggcatatacgctgctatcgttggcttttacataatcatcgcgctcttttaacgtctttttaaacgcctcggcgcgggtcaacggtttcccatcagcgccttttccccaatacgcgtccgcttcttttttagctaccgctattttcttatccagggcagagagttgttcttcaagaccggggatcgacgctttctgcgcacgccaggaggcttcaatgttgccaaaccgatagttaaagtcatcactgttgacgatcaggtatttatcattcgttttaatgtcgtcaatagcccggccctgatcgctggctgccatttgtaatgagtaatagttcaccgtccagccagaggctggcgtccctttactggttaacatggcagaaaatttaacgggacgatctttggtccaggttttttcaacaaaataataatccgccgccataccaacgccggtatacatatcttcacgggaagaaatatccccttcggcagaccaggtggcctgattgcccgtcgaatcaagattttttaaggtaatggaatccagtttaagtatgccgtggtactgcttactaaactgttcttttaagatgttatcggagggttgagcaacctctgcccaactatagcctgaaatcagggcaaacagcgctgcgccagcaatccattgtcgaaccacttgtggacctcccgtccagagacatgacacccacgattatcataaccaggatgataattagcaagataatagtgttggttgtgcgagaggtcttccaaagatagccccggccttccgaccggggcattatctttaatactgattgaacatcgtctggatctgttttggatctttagtctgggttaacgccagttgcagtaagacacgcgctttttgcgggttcagcgtgccggaagcgacaaagccgtattttgcatcgtcaacttccgcatcctgcgtggttgcgccagtcggcactcgtgaagaacgcaccactaccgtaccgttgtgcgcggcggtcgccagggtatcaaagaccgttttatacaggttgccgttacccactcctgcgctcacgatcccgtcataacccgcgtctaccagcgcttttgccggcagatcggacgcattcgcatagttataaacgataccgactttcggcaacgcggtcagcttcgacacgtcgaacggggtggaggtggtatgtttacgctctggcgtacgctggtagtcaattttaccgttgtggatataacccagcgggccgtagttaaccgctttaaacgtcgccacgtcagtcgtattggtcttagtgacgtcgcgtccgtccatgacggtatcattcattaccaccagcacgccgcggttggcagactgtttatcagccgctgttactaccgcattatagaggttgaacgggccatctgcgctcattgacgtggaaggacgcatcgcgccgaccagtaccaccggtttattgcatttcacggtcagatcgaggaaataagcggtctcttccatcgtatcagtaccgtgggtgatcacgaaaccgtcggtgctgtcgcactcggtattgatttttttcgccagcgtgagccagacttcatcgttcatatcctgcgagccaatgttaacgacctgctcgcctttcactaccgcaatgtccttcaattgaggaacggcatccaccagattttcgacgccgactttacctgccgtataatttgattttgttgctgaatcaccaccgccagcgatcgttccgccggtcgctaagatggtgatattcggtaaagcgaacgctgcgccgctgaaacccattaccagagcagctaatgccgttttcctgaaaaactccatgttatatctccagttatgtcaactggtcgcattatctctatattgcagacgaataatgtgacgccatacgattaaccagcgatatatatccgacagagagtattttttagagatggataacaaaatgcaggaaaaaacagaataaaaaggcgcagatacgatctgcgccattgtttaaaaaggaaagattacttcaggctgccaaccagcgctttgcggctatcttctaaggtcactacgcggctacagacatctttgccaaactgctggaaatctttctcctggtttttccattcgttctggatagcggtttgcaaaccacctagactgcccatcacgccctgtaaaggattgccgccgcctttaagcaccgctttggcgcccatttcgttaatgctgtcctgcaaaataccgcccatcgcctgattcaccaactgctgaccgtcggcacgcacctggtcgatagccttatagtggaacgtcaggccgtccgtacgatgttcgataatgcggttcatttgcgcttttaattgcgcatcaagcttcgtcagacggctacgcatgttgctgctttcgcccacctctttagcgatgattttatccagcgccacgcggcctttttcgacgcgcgatcgggcgccctcatcaatccacggcagcgcgcttcgcagttccgcctggtaatctttcgcctgctcgcgctgcgcggcgctaagggtgtactgcttaccgttgtacatcacattgccgtccggcgtgatcaccaggttgccgttttcacctttcacctgcaccgtttgtggactcaggatcacatcgtcacgcggcgtgacgctgcatttgtaatctgcatgagcggccatcgccgtaaacgttagcactgtcgccagcagcgttttgcgcatcataactttccctcaagacaaagcgggccggcatttgccgaccctgtacttattagtcccaccaaacgtcgaaaagttcgctggttcggacttcttcaaggttgcgcgcttccagccacttacgcacaatcgcctgatgttcttcggtacatttaccgatttcctgcatacaaatcagcccttcccaggccaggtagccgctgccgtcaaacgccagtttattaggctcaataacgtcattaataaagtcatcgacagtcttatcgacctgctcttcagatgtaccttccggaaaacgccatgccaccgaaaatcctaattcctggaattcgtcaatgtgcatttttttacgcagacgacgactacggttctttgccattatttcaccctctcgaacattaagtcccatacgccatgaccaagacgatggccacgttgttcaaatttcgttaccgggcgcgattccgggcgcggtacataatcattgctctctgacagatttttgtacccgtcgatagaagacatgacttcaagcatgtgttccgcatacgcttcccagtcggtcgccatatggaaaacgccgcccaatttcagcttgctcaataccagttcagcaaacggcacctgaacgatacggcgtttattatgacgcgctttatgccacgggtcagggaaaaagagctgaaccatcgataaagaattgtcaggaatcattttatgcaacacttctaccgcgtcatggcacatgacgcgcaggttttcaacgccctcttcattagcggacgccagacacgcgccgacaccgggtgaatgcacttcaatgccgaggaaattctgctccgggcgcgctttcgccatcgccacgagagacgcccccatgccaaaaccaatctccagcgtcaccggcgcttcgcgaccaaacaacgtggcgaaatctaccggcgcttcgctgaactcgacgcccatcaccggccagtagttttccagcgcgtgctcttgcccctttgtcagtcgcccctggcgacgaacaaaactacgaatacggcgcagcgggcgaccgttttcatcaaattccggtgaaatgacgtcgtttttcataaaagtgtagtctgctgtgtttgagttctgaaaacgggcattatccaaagttagttgccggatgcaagcatgaagcgcactgcggaaagttccggtttacaccctgcggcctctgtgctgcaatcttgcccccggcaataatgaatgagtttccatgcaagcgtctcaattttcagcccaggttctggactggtacgacaaatacgggcggaaaacgctgccctggcaaattaacaagacgccttacaaagtatggctctcggaagtcatgttgcaacaaacgcaggtgacgacggtgattccttactttgagcgatttatggcgcgctttccgacagtgacggatttagcgaatgcgccgctggatgaagtgctccatttatggaccgggctcggctattacgcccgcgcgcgtaatttgcataaagcggcgcaacaggtggcgacgcttcacggtggagaattcccgcaaacttttgccgaaatcgccgcgctacccggcgtcgggcgctcaaccgccggcgcgattctctccctcgcgttaggtaaacattatccgattcttgatggaaacgttaaacgtgtgctggctcgctgttatgctgttagcggctggcctggaaaaaaagaggtggagaatacgctgtggacgttgagcgagcaagtgacgcccgcacgcggcgtggagcgttttaatcaggcgatgatggatctgggcgcgatggtttgtacgcgttcaaagccaaagtgcaccctgtgtccgctgcaaaacggttgtatcgccgctgcgcatgaaagctggtcacgctatccgggcaagaaaccgaaacagacgttgccggagcggacgggttactttttattgttacagcataatcaggagattttcctggcgcagcgtcctcccagcggtttatggggcggactctactgctttccgcagttcgccagagaagatgaattacgtgaatggctggcgcaacggcatgttaacgctgataatttgacccagcttaatgcgtttcgccacacatttagccatttccatctggatattgtgcctatgtggcttcccgtgtcgtcactggacgcctgcatggatgaaggcagcgcgctctggtataacttagcgcaaccgccgtcagtcggactggcggcccccgtggagcgcttgttacagcagttacgtaccggagcgccagtttaacgccccggtcgatgaagaggatgacttatgagcagaacgattttttgtacttacctgcaacgcgacgctgaagggcaagattttcagctctaccctggcgaactgggaaaacgtatctataacgagatctctaaggacgcgtgggcgcagtggcagcataagcagaccatgttgattaacgagaaaaagctcaacatgatgaacgccgagcaccgtaagctgctggaacaggagatggtgagcttcctgttcgaaggcaaagacgttcatatcgaaggttatacgccggaagataaaaaataggcccgttgctgaatgacgctgcgcttattcggcctgtgagttatgccggataagcccttagcgtcgctgcccggcaacatggcataacgacaacacaacatgcactcccggaatgatgaaaaaattactcgcgcttgctgttattgcgccgttgctcatctcctgctccagttcgaccaaaaaaggcgagacgtataatgaagcctgggtcaaggataccaacggctttgatattttgatggggcaatttgccaacaatattgaaaatctgtggggatataaggaagtcctgattgccgggccgaaagactacgtcaaatataccgatcagttccagacccgtagccacatcaactttgatgatgggaccattaccgttgaaaccatcgccgggacggaacctaccgcacatctgcgccgggctattattaaaacgttgctcatgggtgacgacccaacctccgtcgatctttactccgatgtcgatgacataaaaatttctaaagaacccttcctgtatggtcaggtcctcgacaataccggccagcctattcgctgggaaggccgcgccacgacattcgcggattacttgctgaaaacgcggctcaaaagccgcagtaacggcctgcgtattatttacagcgtcaccattaatctggtgccgaaccaccttgataaacgcgcgcataaatacattggcatggtacgccaggcctcccgtaaatacggcgttgacgagtcgctgattctggcgattatgcaaacggagtcctcgtttaacccgtatgcggtcagccacgcggatgcgctgggcctgatgcaggtagtgcaacacagcgccgggaaagatgttttccgttctcagggtaagtccggcacgccaagccgtaacttcctgttcgaccccgccagcaatatcgataccggcacagcgtatctggcaatgttgaataatgtctatctgagcggtattgagaatccgacgtcgcggcgctatgcggtcattaccgcctacaatggcggcgcaggcagcgtattacgcgtattctcgaacgataagattcaggccgcgaatatgattaaccgcatgtcgccgggggatgtgtaccagatattaaccacccgacatccatctgcggagtcgcgccgctatctgtataaggtgaattccgcccagcgatcgtatcgccgccgataaaccatcgcatcccgcctctggttggcaaatgacagaggcgggaaaggtaaaagtgttaactccgtcacccttttgctttgcaatcagaaattgtttgcaaatatttgtcacaggtaacaaaaaaagcccgcctctcattgatagaatcacaccaaatcacaacggcaaatgtgccttttaaaacattcatccgctctcaggtgtgaggaaattaacatgaatcttaagctgcagcttaaaatactctcttttctgcagttctgtctgtggggaagctggctcactaccctgggctcgtatatgttcgtcaccttaaaatttgacggcgcatctattggcgcagtttatagttcactggggattgccgccgtctttatgccgaccttgctaggcattgtggctgacaaatggctgagcgcgaaatgggtctatgccctgtgtcatgtcgtcggcgccatcacgctattcatggccgcggaagtcactacgcctggggcgatgttctttgtgatcctgcttaactcgttggcctatatgccgacgttgggcttgatcaatactatatcgtattaccgcctgcagtctgccggcatggatattgtgactgacttcccgcctatccgtatctggggcaccattggctttattctggcgatgtggggcgtgagtttctccggtttcgagctgagccatatgcagctttatatcggcgcgacgctttccgttctgctggtactgtttacctttaccctgccgcacattccggtggcgaaccaacagaaaaaccagagctggacatcaatgctgggccttgacgcttttgcgctgtttaaaaataagcggatggcgattttcttcatcttctccatgatgctgggcgcggaactgcagatcactaacatgtttggcaacaccttcctgcatagctttgataaagatccgctattcgccagtagctttatcgtgcagcacgcctcggtgatgatgtcgatttcgcagatttctgaaacgttattcatcctgaccattccgttcttcctgagccgctatggtattaagaacgttatgcttatcagtattgtggcgtggatgctgcgtttcggcctgttcgcttatggcgacccgacgccgttcggtaccgttctgctggtactgtcgatgattgtgtacggctgcgccttcgacttcttcaacatttctggctcggtgtttgtcgaaaaagaagtacgcccggaaatccgcgccagcgcgcaggggatgttcctgatgatgaccaatggcttcggctgtatcctgggcggcattgtgagcggtaaagtggtggagtattacactcaaaacggcattaccgactggcagaccgtgtggctcatcttcgcaggctactcgctggtgctggccttcgcgttcgtagccttgttcaaatacaaacacgttcgcgttccggcaagttcgcaacccgttgcacattaatccttgccctgtttcgcaggccggataaggtgtaaatgccttatccggcctgcaggcaacgttactttaaaacatatccgtacaagcgttgaattccatcggcatcggtctcgctatataccccctgcaattccggcgaaaaaccaggcaacagattgatgccctcttccagcgccaaaaaataacgctgcgccgcgccgccccaaatctcccccggcaccacgcacagtacgcccggcgggtatggcaatgccccctcggcagcaatacgcccgcccgcctcgctgatacgcaccagctctacatcgccgcgaataaaggcgctgttggcatcctgtgggttcatcgccacatgcggcaggctttctttgcggaacatcgctttttgcagatccttaacgtcaaagctaacgtacaggttgtgcatctcctgacatagctcacgcagggtgtaatcgcggtagcgcaccgggtatttctgaaaaaccgtcggcaatacatccgcaagcggcgtatcgtcttcaatgtgccgttcaaattgcgccagcatcgcgaccagtcgcgccagcttctcttcgctctcggcgggtgtcagcaagaacagaatcgagttgagatcgcacttctcaggcacaataccgttctcacgcagatagtgggcgagaatggtcgccgggatgccgaattcggtgtatcgcccactatcggcatcaatacctggcgtggtcagtaacagtttacaggggtcgacaaaatactggtcatccgcatagccctcaaagccatgccatttcgccccgggttcaaaactgaagaaacgacgattgctggcaatggtctccgtcggatatgcctgccacggcttgccgtcaaccaccagtgggataaagggctgaagcagtttgcaacgggcgagaatggctttacgcgcgtcaatgcccagcgcaacgcactccgcccacaggcggcgaccgctctccccttcgtggattttggcattgacatccagcgccgcaaacagcgggtagaacggactggttgaagcatgcaacatgaaggcgttgttcaggcgtttgtgcgggcaaaaacgcgcctggccgcgaatatggttatcttttttgtggatctgcgaggtttgtgagaaccccgcctgttgcttatgtaccgattgggtcacaaagatcccagggtcgttttcattaagctccagccgcaacggcgaggtatccgccatcatattgataaactgctcatagcctacccacgcggagtcaaacagaatgtaatcgcagagatgcccgattttatccaccacctgacgggcgttgtaaatagtgccgtcataggtacccagctgaatgatcgccaggcggaacggacgcgacgcatcggcgctttccggcatcacgtcacgaatctggtcgcgcaggtacgtttcatcaaaacagtgcgcatcaatgccaccgataaaaccaaacgggttacgcgccgcttcaagatagactggcgtcgccccggcctgaatcagggcgccgtggtggttggatttgtgattattacgatcaaacagcaccagatcgccgcgcgtcagcagggcgttggtgaccactttattcgccgccgaagtcccattcagcacaaagtaggttttatccgcattaaacacttttgccgcaaatttctgcgcgtgtttggcagaaccttcatgtattagcagatcgccaagtttcacatcggcgttacacatatccgcacgaaacaggttttcaccaaaaaagtcataaaaatggcggcctgcgggatgttttctaaaaaattcgccatgctggtgccccgggcaagcaaaagtactattccccatgtcgacatactgggtcagggtgccataaaagggcggcagaagttccgcttcgtagcgacaggcagcgttttccagctccagccattcctgcgcgttcccgactattaccgccgtaacgccgacaggcgcgctgacgggttcatccgcaagcataaacaccggcaggtgaaaaccggtgcgtttaagcaacgccagaataccgctacggctgtcggcagtggtaatgacgactgcggccacatcggtaaagtcggtactgtccagcgccactacgtttcggtgggtggagagacggggaatgagttcaccgctggcggcaatattcattgatttcataagcgcaaatatccgtttcgggagtagagtaaccccagacaaggcccgatgccttgcccaacgagatgccgggtcaaactggataccagctccgaccgccagacatcagtaaaaacagactgtttctgattttactgttgtcctgcagtgagcgtgcgctgccctcaccgcatagcggggatgacaaaaaaaggaaagaaaggggcaaacctcgcgcagtcaggcgacagtgaagacaatataaaggcgctatgttcatcccggcgagccccatgctggcaggagaaatttcgcgcaatcatggcacctttcaccaggcggcgcaaggtaaaatcagcgctctatacgtcacagataatcaagctattaacagcttaatcgcgtgataataaggcaatttgaaagacaaataacaggagtcattgtggtaattggaccttttattaacgctggcgcaattttattcggcggcgttattggcgcgctgttaagtcagcgtctgccagaacggattcgcgtctcaatgacgtctatttttggtctgtgctctctgggaattggcattctgctggtgatgaagtgcgctaatcttccggtgatggtgctggcgacgctggtcggcgcgcttatcggcgagttttgtttgctggaaaaaggcattaatggcgcagtcgcgaaaatccaacaattatttatggcatcgggtaagaagccgacacacgactcatttattcaaagttacgtcgctatcattgtacttttttgcgccagcggcaccggtattttcggcgcgatgcatgaagggatgaccggcgatccaaacattttgatcgctaaatcttttctggattttttcactgccattattttcgcctgttcgcttggcatcgccgtttcggcgatttgcgcgccgatgttgattatccagttaacgcttgccgcctgcgccaccctcattcttccactgaccacgccggcaatgatgggcgactttagcgccgtgggtggactgctgctggtggctaccggcttgcgtgtatgtggaatcaaaatgtttccggtagtgaatatgctcccggcgctgttgctggcgatgccgatctccgccgcatgggcgatgttttttgcctgattctgcgtgcaataacaacaaagtggtgatagattgtgcagtctacgttgatttgaagaaatttcgttgacgaagcgaggcgattacggtttaatgcgcctcgttgcccggatagctcagtcggtagagcaggggattgaaaatccccgtgtccttggttcgattccgagtccgggcaccactttcccttttttatgctttcttatgaattcctcgatgtcttcaagtcaataagtttgaacatagactctttccagaaattattgccatatgatctccattagaccaatataaacggatgcgtgatcataataaaggcagtaatagtaagttttaacattaaacatactgcgaaatttcaattaagtttccatcagggtccctgatgtagatagacattatctcgcctgtggctccagttctctcaaccgggccttcaacaatggaaatgcctgcctgtaagatctcagacacaacatcatttatcggtgtcgatgtaataaaacataaatcggcagatcccggcgttggtctactcgcttttggttcgaactccatttcttgctgatggaggttaattttttgcgctccaaatattaacgcttttctgttttgtttaaatgttaccgcagaaaaaccaagtacctcttcgtagaatcttattgtggttgatatatcagataccgttaatacaaggtgatcaattctgtcaattatcatttgaatagactcatgatgtttatattttagggatgctacattaaaaaatagcattaacctacttttaaatcagatgcattttttttgcatctactctaagttgctgccgaaaattgggatgtgccaattcaatgatgctgagcgcacgctcggttgaagagagccccttcaggtttacggagccaaattcagtgactatccagtgcgtatccgttcgtggggttgttacaggcccctcaaggcggggaacaatacgagaaatcgtatcattcgcggccgttgagcgggtcgtaataatggaacgacctcctttagatgcatatgcgcctctgacaaaatccaattgccctcctgaagcgctgtactggtgtccaagcaaatattcagagttacaggcaccagtgagatcgatttgtaaggtagcgttaatggagacaacattctcattttgcgcaatgatccccggatcgttaacataatcgacaggccgactaaaaaaagaggggttgtcgttgagatagtcatacatatccttttgtcccatagcaaaagtaaatacagacattccccggtcgatatttttacgctgattggtaacgacgccttgttgaatcaaacttaccaaccccggattcagcgcctctgtatggacccccagatcattatgttccttgagcgcattacagatgagctccggtaatgcgccgacccccatctggagacaagcgccatctggcacaagagaagcgataatctgactgatagcaatatcttcggctacggcagtacgtattggtagttcaattaaagggacatggttttcaacaatggcgtcaatttctgaaatatggattgcagcaccttctccatgaacgcgcggcatatatttgttaacttcgacaataagctttttagctgtcctcgcaatccgggtggaataatcgtttccagttccaaaattaaaatagccatacttatccataggggacacggtgtgaataaaggtatcaataccaatatcatcagctagtaatcgcgtcgcctgatgaaaatttgaaggtacatagttaactatttttcgcccggaactctcaatcccctgacgtattaaagcccgttcaataccggtaataaacatactgtagagatgaatatagtcacttagctcataacggaaaatagtgttcccggcaatgctggctgtttcataacagtaaacccgcagatcgttgatttctccccttttcgctcgctttgccagcgcattcagcaaagctggaggctctgctgcaaacattcccatagagaggtgactgccggaggtaattaaagtaaccgcctcgtcaggcgtcacgcatttttcggcatacactgcattaacattcatcatgactctaaacctcagggcgatttctcaataagcggcgtcttcttcaggcgaacatccacagcaataaactaacattgttcgttcgaagcgcatgacctctacaccattctggttaataccacatgtccgaacggtaacgatgccttgtcccgggcgactatttgacaggcgtttgctgagtacagtgctttcagcataaagtgtatcccctgcgaaaaccggatggacggcttgtaccttatcccagccaagattggccacgaccttggcgctgacagtacgcacgctcataccggttaaaagcgccagagtgaacgttgaatcaaccagtaactttttccattccgttttgctggcgtaagccgcatcgaaatggaccggctgcacattgagagtgagcagggtaaaccacacattatcggcgtccagaaccgtccggccgggacgatgttcaaaaacatcaccgggatgaaaatcctcccagtaaagacccgaaatttctcggtagcgcccctcgctaatggttttataagcgggtaataacgtgttcataatcaattcctctgttaataaaatcaggaaaagatccctgcccgggcgagtaatctccgggcctgacgggcaacggctgcatctatcatcatgccgctaacgatcccgacgcctttggcattctctgtcagtactgcacgagcatgattaatttctgccgttgtaggagtaaatgcggcgttgattacactaatctgagcggggtgaatagccgattttgcagaaaaaccaaaactgagcgcctgcagcgtttcctctttcagacctgaaaaatcgcctatatcaaagaagggagcatctattgcaagaagccctttcatagcgcaggcagccactattctggcccgcgccagcgcaagaggctcccaggcgggtgtggcgccaatgtcagccgccatatctgcggcgccaaacatcaacccgcagagtctgggggtggcgtccgcaatagactctacggcattaagcccaacaactgactcaataatgccaataaggcgagtatcagaaccagccatcatgataagactatccacgatttgcaggtgcgcggctgactctgtttttggaagaataatgtaatcaggaaaaaaacggcattccagtaacatatgcaggtcttcaatgccagcatgagtattcattccattaattcttaatgctattttcagcgatgagtttggtcgggatgaaaggaactgcatcgcaattttccgggcctgcgccttgtcattcggggtgacggagtcttcaagatcgataatagaaatgtccgccgcactttcaactgcttttatgaaacgttctggtcgaattgctggggtaaaaagccagctacgtgtcggtgtatgagaaatatcgggcatattgcacctcctgttaacctcactatgcgctcgctggtttcattcttccaatatatgatggtgccattcttaattgcttttggagatgaggatggaactgcgccatattcgctattttctcgccgtcgctgaagagcggcatttcacgcgggctgcgacaaaattaggcataggtcagccgccgctaagccaacagattaaggatctggaaagagagctgggagcgcagctattccggagagtgcctcatggcgcggaattaaccgaggctggaaaagcattttatgatgttgttaaagggatgcctgctaccgcgacaagagccgtgctggcggcgcagcgtgtcgccaggggggagtcgggcgtgttaagggtgggttttactgcctctgcggcatttaacagtgtggtgcccggcgcaatccgtactttcaagcgggcttatcctgacgttcgtttgcagcttgaggaaggaaatacaacccaactggctgatgaattgaatgaaggatcgctggatgttgcctttctgagacccggttttacaggcaatgaacggttccagctcaggttactgtctgaagagccaatggttattgtgctggcagaaacgcatcctgctgcggcgtgtaaacagattgcactctcgattctcaaagatgagttttttttactcttcccacgtgaaatcggcctgtcgctttatgacgcagtgatcaaggcctgcggtaaagcgggctttgaaccgaaaattggtcaactcgtgccgcaaatttcgtcagtcattaaccttgtgtcggcagagatgggcgtgtcgatggttccagattcaatgagacaggttaatgtcaagggagtagtataccgccccgttgcagaccagatgcccgtcgcaaaactggctctggcataccggcgcggcgatacatcgccaacgctgagaaacttcatcctgaaagtcactggctgaatgcggttatgtgagcgttgaataatcatttgaaacgtaaccaataattattggtccgattttgtgtctaaaggaatcgctaacggagcaggaactggctgcaatgtctgtggatcgacagccagataacgcccggttttactgtcgatacccacataatcgataagcttgcctttggcataaagcaccattgtctgttttgcaaatgcctcatatgcgctgctcagtattttcactttatccgcataatttgctgcgagattatgcgtttccagggggtcacgttgcaggttgaataattcccatggcgcattacccgcctgtgggaatactgtgacaagacgacgcaatttccattccccatctatccaggccgcctgattatggagttcaacaccatattgtgtgcgaggcgcgtgcagactttcaccggtcagatagcgtttaaaactcacgccgatcattggcagtgtcggtctttcagataatgatttactggcatcaatacctgcaaattcatagagcgtgggcgcaacatcatacgccgccatcgtggcgttatctatggcgccatgatggatgataccaggaccggaaatcataaaactggtattaattcccccctgaccgctggtcgttttgtgatagcgaccataaggcgcattgctgacatcagcccagtggggaccataagagataaatgaatttttacgaccaatattttcgtaacgattatcgaattgcttccaaaaatccggttcagattcatagtgaaagccctccgccggattcacaccattatcacttaagaagaccagaatcgtgtttttatcgcgcccggtcttttttaacgtctcaataacggtgccgatctgtgcatccatattggcgatcatagcagcgtaaacctgcatcaccttcgccgtatatttctgctgttccggggtcatcgcctgccattctttatcaagttccagtcctggcagaggtatgtcatcacgcaggaaacccagtttcttcaaacgagcaatacgctgacgatagacgtctgcatagccctgttcatactgacttttaaaacgactaatccattcatccggcgcctgcagaggatcatgtggcgcagtaaaggccaaccacgcgaagataggttgttcccgtggcgtctcgctgatccagcgattaatctggctggcataggcttcgctggagtaaaaactggagggcagtgaaatgcgctgattgtcacgggtataataggtatgaaatatctccacggttcccagcggcacggcatcatcaaagtgactggcgcctccccccatcaaggcgaaagaatgacgaaagccccgatcttttggcgtcgagcctggcgtaaaaccaagatgccatttacccgccatcagcgtattgtaaccagcatctttaaagcgttcagccatggtcgtcacccgatcagtcaggcgcaattcatagccttccttacctatggtattttcataccaccacataccgcctatacccgcttgctgactggtgttcccggttaatagcatcgcacgggcgggagcagacatgggagacgtgtaatattgactcatccgcacgccgttctcagccatcgcctgcaaattaggcgttgggatttccccaccgaagggagtgatatcagaatatcccatatcatcagcgataatcacgataatatcaggacgttcgttttgcgtactgtgcgccgtaccggagaagataatgctaagtgtggcaagtgttacttcttttttcacggcttattctccatttcagactacggatgttgtacaagagcggcgggcaaatgcggcaagaggaaccatcagcccgaaaatctacccataacgtcagcacgccaggctttcagtccattcagatcccggggccaggcgcgtagcggagccagaatctccgtgaaaaaagagtaatagccgctacaaagtcggttgtagccggcactgttgatatgtgcggggcagcctccctggcagactattttcacagaacaccgttgacactcccggcgctggcttttcttaataccaaagggaagccgggttgcggaatctacggctggcgctaacgtattattagcaagctgtcccaggtaatgctggctattaatcagatgatcgcaggcatagagtttgccgtccggctccatgaccagattcgttccgcagcgggcggaatggacacaggtggcgctgatatgcgtaaaatattgtgcccatgcctgttcaatgttgatcacaaaaacccgtcccatatcgccgcgtttgcgccattgacgccagatatcaatcatgaaacgtccccagttatccgcactcaattggtaacgttgctgtagggcgttgccttcgttcatcagtggctgaaattgcagataacgaacgccaaggctaacaacatgatcgtagatggctgccgcatggcgagccatgtcatcatgcacgacaatcagtacattaaaatcgactcgatagtgttgtaacaatgtgattccccgcaacaccgccggatagctggcctcgccgcgtttgcccggacgatgatgattttgcaagtcttcactgccctcaagactgatgccaatagtaaaattattgtcgcgaaacagacggcaccaggcatcgtttaacaacgtcgcattcgtttgcagactattactgatcgtcacgccgtcaggcgcatatcgttgttgaagcgctattacctttttataaaaaccgattccggctaaaagcggttcaccgccttgccagacaaaattaatttcacgcgcactggcaggttgcgccgcaatatagcgacaaataaaaatctccagcgttgattcattcattttttctacgggcgtttcgccctgtggataataacaatagcggcaggccagattacatgcagggcctatgggctttgccagaatatgaaagggtatctgcgcgcgatattccgtcattacggggatttgttgttgccgtaatgtgttgagattcaacattattctgtcctgtagttatcatttctgatgcggagacatgactcacatttcgcaatagcgttcgtctggcgctgcgggcagaatgccgagagcaggctgtatctattgatacgccggttttctgcatagcgcatgacgctattgaaacgttatttagcaaatcctgtctgagccagaaattaagtctctgttaacctgcgctattacagaaaatcatagaacagtcgtctcaaaagaatatcgtcctgaaggacgagaactcacggcattttcaggagatgagtcaaccgcgacagaaaaaaatcatattaataattttaaattattttttagaaaaccagacaggatttaaattaaaatcatttattttcaagatgttataaaaaataccgcaacatacgtcacattattaacatgtgaatgattgtgttaaccgaatgtaaattgtatgtttcaacataccactattttactgcgccccgacgcgctcatccggatggaaggagataacatgtcagccttatcaactactggccataatgacgggatcactctccattgcttacagagcattgcgcaactcattcctctgtcgtcggcggttttttatcgtgttaatgcttatttaaagccagaagcctatgttttacataacatttctaatagcacacaccaacaatatctggagcattttcaaccattagacccgctatcgccttcccggttcggccaacaggttgttaccgtagcgacgatgacgcccggtatctgtgcccgacatcgccattattatcatgaatttatgctacctaatcatgtgtgcgacatgattgagatctttattcgtcggggccatcgtattatcgcgggcatttcattaatgcgcgatatacctttttccagcgaagagcgtttgcgagcccaggcagtacaaccattactgggactggcgattcatgattctcttcaggaagacaacgatctggagtcaatattgaccgccaaagagcgtgaaattgtgggaatggtctgcgaaggggccagcaacaaattgattgcccgtcagttgaatatttctctctcaacagtgaaaacgcatttacgtaatatttttgctaaaacagaagtgataaatcgcacggaactggtttcccgaaccagaatgtcttcggtacaacatgcacagcatatgtgaaagcgtgctttttaacccgcgtcaattgcgggtcttttccccattgtcatatatgcctgaattaataccactctctgatctgatgcctcaataaaatgtcatattatctggcgtcggtatcctgttgcagccattgattcatggcctgattgatcatatttatcacactaagcagaagaacacgctggtgccgctcaagccgcagataacggcgcagcggcggcattttacaaactacttcgctagcagcccatagctcaatgctgcaataccattccttatgatgtaaaaccagcgtaaaccgacgataatccagttcactcagtgcctgttgtaaattggggaaacaattaagatagttaatcagcccggcggtacttttgctgccagtaaaaatgacgggataacgtttcagccatccgggctgatgaacgcgaattttgccctgcaaaggataattgattgtgcctttcaccctgaattcacaactgtgaatactggccatgaataaccgtttttgctgagcatggcagataacctgggtaaatgcattcagatgcagcacggcgctatgttcggtcaatttttcacaacgccagccgctcaaatcacgtaacaccatgttcattaatgtgctcttaaaccaggggacggaggacatctggcgtcatctcttcattgtttcgcttttcataattgcccatagcccgttccacgacctcttctaccggaagcgggaggaaaggattaacccgttgcacacataatgtccagaataaggcataggcggcagtcaatccaagcataataccgaatggtataagtacatcccgactgttcattcctggaggcgcgatattaataatggcgataataatacccacgctcgaaataatctgaggtaagggaaaccagggggcccggtaagcgcgtggtaaatcggggcgccgaatacgtaagataacgaccgataacgttaccagcagataagctactccccaggcgcagaccgcagcgaggatcagcggaacaatgtggtcgatatcaccgttcagataccaggcatgtaaacagggaatcgcaacaccgaatgcgatggcgatgaccggtgttttaaagcgggggtgcaaccaggtcagaaaccgcggcaaagcgccgtccagcgccatgccgtatataatacgcggtactgccgccattagcgtattaatcgtcgcacatcccgctaacaacaaccccacgcccagccagtattgcccgacatgtcccatgacacgattggcaaaggcgggaatagccatcggcgtatccagtaaaaagatatggtttgccgcatcgaccaccacattatttacctgccggttaatcgcagcgccatagaggaacatacaacctgccaccgctaaaaggccaagcgccatcgctctgggaatcgtacgatgcgcttttttaatttccggcgccattggcgtgaccagttcacaaccgacgaacataaacatcgccatgccaatataaccaaacagaccagaaagattactgacatcaagaggtgcgccaaaccacccggaatgatgagtgaccggggataacaggatcccgcataaaccgaagatggtcagggtagtccacataccgaatgtaagaaacacttccaccttgccaaatacttcaacaccaatggcattcagtaacccgaaaaccactaccatgccgacgccaaccatccaggtattgtgctgcatggccacgtgttcgctaacagactcaaagttcaccagcgccatgacgccagcgagaatcgtttctgccgtgccggcaaaaatgtgtacgatcaggtaagcgcaaagcgcaccggtgatagcgaaaaaacgccccatcccgcaggaaatatagtcgtagacggagccagtcgtgggaataagcgttgccgcttcggcaaaggtggtaatctgcgcttgcatcataataaatgccagtaataccgcaagagcaaaggtatctccccctgagccaaaaccactggtcacggtcaggatcaccgggcttgccataatcagcccgacggagctggcaagcgtcgtggggaaaccaataacgccacgttcaagatggctggcaagtctgtttttaaacatggtcaacctcttcactattattacaacaataaattaccgctccggaataacgcttatttatggcaggcaccgtatctaacaggtatcgtcctgaagagggataacggtaaataacgttgtgacgccgtccccgcatgcgctaatagcaagtggggagcgcgttattctccccagtgatgccaacgctactgacgaacaattaaaggattcaaccctgcttatggctttcaacttttgccagataatgttttacaaaacggggcgttaaaactttccatgccacttcggttccctgttcaacaaaccaactatcgcctggtgaaaaacgtatcggttcctgacccgcaacagtgagttccacttccccttccagcacggttgcgtgctcggtaaagggataaatcatagtgaaaccgccgcgggtcgatgaaaacagtccacaggtaaatacgtcctcaggtttaccgtaaatcatcgcaacggcgacctggggatcgccttctgttggcaacgcccccaacaggctgacactcccgattggctgtaattcaggaacaggttgattgagtttaaaagcttgcattaatgttctcctggttaattccggcctttccagaaaccggctgtttgatgtatcagttttcccgcactgaccagcaatagacgtagactgtcgcgaccataaattgtcgcgtggggaatgctactcatcagacgataccgctcggaaccgccatttattccttcggccaggattttgcatacaatatgggaaggcgtgacgccaaatccggaataaccctgaacataaaaaacattattgtgctcacgaagcgtgccaatctgcggaaacagattcgcgctacaggccatcggtccgccccaggcaaaatcgattttaacgtctttcaaataaggaaagacctccgtcaacagagtgcggttccaggcagcaaaatcgtgcggggtatattcaagaaaccttgtggcgctgccaaacagcagacggttttcttttgtgagacggtagtaatttatcaccgggcggatatcactaaaagccccgcgcaagggactgatccgctcaacaagctcgctggagagaggttctgtagagacctgataagaataagtaaccagcgttttcttataaatttctggttccagattattgagaaaactatcacaggcccacagcaatttggccgcttttacgctgcccatcgcagtacgtacccgcacagttttaccgtaactgacctcaaccacaggtgaatattcgaatatcttcacccccagcgaattcgcagcctgagcggagcccagcaataaattcagcgagtggacatgccctccccccatatgcttgagaacaccgcagtagacgtcggaaccgataacctgctgcacgtctttaccggtatagagttcaatatcgtcttccggcgtagcggctttgaattctttttcccattgttgcagcgtttttaactgccgctggttgtaggccagataaccatatccggggacaaaatcagcatcaatatggtatttacgaattcgctcccgaataatgcctgcgccgaggttcgagattttaaacagcgtctccattcccgctgcgcctacatattttttaacggcttcgatgtcgtgacctataccggccatcacctgaccgccgtttcgcccggtgccgccatacccaagatggcgggcttccagaacgacaacattagtgatcccctgctccgccagttccagcgcggtattgatgcctgaaaagccaccgccaatgatcaccacatcggcatcaatatcgtcttgcagagcaggaaaatgcaacgggtattttttcgtcgcgccgtagtaattcaacgcatcgatttttgtattcatcgcgttaccttgtcatcacgcttgactaagaccgctatcacagcacggtaacgttttacaaaatatcgtccggaagaatgacgttctttggaacgatattcagttccaggcaagtatgttgagatggaaaaacgtacattcctgacctacaggcacttctgatgagcgacgtgacattacttgccgaagtaacgacttttttacgccaacgacacggacaatttattgcaggtgaacgtcaggccggaaacggcacgaacttctcggtcactaacccagccaccggcaaaatcatcgccgacgttgtgtcggcaacccctgcgcaggcagaagaggccatgcagagcgccagacgggcgtttgatgtctggcgtaaaatgccaacgttacaacgcggcgcattactgctgaaactggctgatactcttgccgctcatcgtgaagagttagctcaactggaaagcgtctgttcaggtaaaacgattatgctgtcgcgcggtcttgaactcgatcagtcagtggccttcctgcgttactttgccggttgggcaggaaaaataaccggtgaaacgctgaatgtctccctgccatcaatgggagaagagagatacacagcgtttacccaacgccaacccattggcgtggtcgtcggtattgtgccgtggaatttctcaattatgattgctatctggaaactggccgcagcgctggtatgtggctgcaccatcgtcattaaaccaagtgaatataccccgctgacactgctgcgagtcgctgagctggctaaagaggcaggtttccctgatggcgtaattaacgtggtaaacggtgctggcggtgagatagcgcaacagctgatcgcgcatccagattgcgccaaagtgagtttcaccgggtcagtcgcgacaggtgagaaagtccggcgttcggcaacatcgtcaggaaaacgcgttaccctcgaactaggagggaaaaatgcggcgctgtttctcaatgatctcacggcacaagccatggtcaacggtattcttgaagccggttatctgaatcaagggcaaatttgtgctgccgcagagcgtttttatctgccccaggaaaaactggatacggtcatgacgctcctcagacaacggttatcggagatcgtgcccggctcgcctttagatgaaaaaacggtgatgggcccgctggcgaatcaggttcagcttgaaaaagtgctgcgtctgattcaacgtgcacgggaagaaggggataccattgtttatggcggtgaaactttacccggcgaagggtactttttacagccgacagcggtaaaagtgcgtagtaaaaacagtacgctgatgcacgaggagacctttggccctgtctgtagctttatcggttatcagaatgaaaaagaggcgctttcgcatatcaacgattcgccattcggccttgctgcaagtgtgtggtcggaaaatatatctaaggcattacgctacgctgaagatattgatgctggcatggtgtgggtcaatatgcataccttcctcgatcccgcggtaccctttggagggatgaaaggatcgggcataggtcgtgaatttggcagcgcgtttattgatgactataccgaacttaaatctgtcatggtccgttattaaccatcctgaaaatgatgcaggcagatcaaccataccgaaaggtggactgtctgcctgattatcaggttcgctcgctgcgtttttttgcttttgggataatgttaaacgcccggcccggcgttccttcctgcattactagcgccatctaccgttagagtaggctatctccagccttaacggttcagactcatcctgtaacatcgcttccaaagacaacgccagcgtctgatgatgggcatcttttacactgactttcagcatattgatgctcggttcataacgtaaaatagcagcgcgaagctcacggcaaaaccagttgagaacccgtttgtcacccacattcacctcgtgccattccggcataccccgagtgagcagcggcggtaatgtctcgccacctggcacggcgcaagagttgaataaacacattaacttgcgtcgtaccaattcatgtgggcttatcccctcaaccaagagcctgtcgaatagcgcgaccggaatggttggtgtcatcatcatttccctatctggttcatcgccagatcccatactgacgttctggactcctgctgagcgccgtctgatttctcggcagtgatttgccattcgattttcgtgaagttcagcgacatcgtttccaccggcttaccgccggcgccgccgctaacactgagttgtgatatcagcacgtttgtcagggtataaacgataagcgaccgcattttgccgtcgtcattgcggcacaacgtcagcaccgcggttctaattagcctcccgctacagcagtactcattgagcacaggcgtggcgaggtcgacaaatttggtgagcgacatttcaccaacatgcgcgcgcccggaagtccgctcagtgaggctaacatcgttatttacctgcattgccacattgtggctataagacatgatctctatctgatcttcaaagccttcaacctggctttcgcctttgatattgtcgagctttaaaaaaatcgcatccatgatttatctccttgttgatcaggtggcagttcagcagccagacgaataccggcggccagcgcttgtgactcttattaaaagcgcaacgaccaaaaaacacagcgtgaaaagcgccaggtttgcagggattttgccgacgtttacccacgtctgatgaacgttattccgctggttgcaaagcaatagagggttttggcccgctgtggccaaatacaattgaggttatactgaacgctctctgccatattcaatcccttttatcgcaaagtatccctggtgccggtatcacagcgtcgttattcaaaaattgacatttcagaataataatcagctatatataaaaaacacatcaaaaagcaaatatcaacttaatttttacttatttaataaaaaaatccaaattgatttacatcaattaacacacacaaaaacattaaaaatcaaagggttaaatgaaaattaatcactatggaaattttatttttcttaatactcacattataaatgttatttgcttattatcctgtgaaaactaaaaaatgatttaaatcaaaaaacaaactattctcgttgattaacgttttgaccgaaataaaaaagattttatacgtcccgggatagtctccctttctgatggacaatatgcattaacgagcgggcaaacaggtaacttctgcccgggtaatccgttacccgactgatattaacattgtcatgaggtgatatcatttgcccggccagccataatcatccggaaccggcgctacgccacgaacatcaggacggagcattttttgtcgatcctcttcgtcatccacccagacactggctatctcttcacaggttgcaaaccatacgccatcatgccctttaatatgttcaatcaaacgtaacaacatcatcatatgatgcccatgaccgattatctgcggatgaagagccatcgcatataaactgttttcctgatggtgataagcataggtaaaaatatccttccagcgtcgcagaacaccgtcagtatcgctcatcccctcctggttgccggtatacgccagtgcgggaaaatcatccagataccagctaacaggaatttccagaatcgcgctggccgggcctgcgatatttcccgtctcccaattcacctgccaacgttgaggatggtaaggcacaagatctctcgccatcaggctactgtcatagagaaaaccggcttcctccagaagatccagcgtattctcgctataatcccaatagggagaacggtatcccacagggcgtatgccgaaatgtcttttataacaggcgaacgccagatccataagtcggcgttctgtatcacgattcaccagcgtcggattttcatgatagtagccatggtgagcgatttcatgcccggcatcaaaaattgctttaatgatttccgggaaggtgtctacagtgtgtccgggaataaaaaaggtggttttgatattattttctttgaacaatttcagaagccttggtacgccaacttgagcaccaaactctcctcgtgacataaaggatggcgacggtcgattaaatccgcccagccataaagactgagcatctacatcaacaccaagattgaccgcaatccttttaccctcaggtaattttaaatatcccataacgacctccagctaatacatagaagggacacattctgttatttaatgtgtgatggccagatattatatatgcctgcttttctgcgtctgtccttgaacgttgttgctgcccccccaagtctattttcatatagaacatcgaggttaatttctcctgaaatgacatcctcttgattgacgtgcgcctctgcgataataccttgtggatttttccacacgacatcacaggggcttaaaattgaacttcgggcccagcagcctggcagtggcccgcccgggtttcctcccaggcaacagtgaacaagataaatttgattttcaatacaacgtgcgtggcaacaatgcctgactcgccaaaatccctgttcagtaaacgtagcggaaggcgttaaaattaactccacaccctgttccgccagcgtcgcggcacactccggtatttctgcttcataacaaatattaaaacccacctttgcaaatggcagttgaaaaacagccattttatcgccttcctgagtataccaaccccgttcagccgggaagatatgcgtcttactgtgagcataatgttcgccatcgggtccccatatatgcgcaacattctcatagcgatctgctccagtctgctccagatgagagccagcaataatgaactgtcctctttctttcgcttcctgttgaaaaagctgcttataggcatccgtgaactgatcaattaaagtaaggtgtgaaatgggtctttcttgccattttttcaatagtgtaaatagctcaatggtaaatagctccgggaagataacgacatcagctccctgacttttattaagaagtatccttacctttgttatgaaatcttcaaaagtgtttatttcggtaacaatatactgacaggctgaaacagtaaaattacgtggcatcgtgatatccccggcatgaaatttaaacttaaattaacgtatagcgcatggagaatattagggagtggacattacgacatcaggttattttttgtgaagctgcgcaaaatatatggagaaaagagtagaagcattgaacctttatttacataaaggggactttatcgatgatcgcagcgagacagagagtcgataaaaatccaggcgaaaaacaataacccttaccacaatattattttcagcatctgaaaataatcaggcaaactaaatgataacgcgctggtataaaaccaacgcgtatttttaccgataagggtaatgaagacggccacccgaaggtggccgttagaacccggtagcgcttcgcttatcaggcctgtgaaaccgagacagctttagcggtgagacgccagcggctgttccgtcattggcgggtggtgcttttccggatctttaatcagtacccacaggatgatggcgccgataatatcgaacagactgagtgcaatgaagaacgggccgtaaccgataatagcgaccaatgcccccataaacaggttgaagcttaactgtcccatccatgccgcagatcctgccagaccggcaaccgtcgcgacctcatttttcttgaacaggtcagcgctcatggtaatcacgacggtagacagcgtctggtgcgcaaaaccgccaatactcatcaatgcaatggcgacatacgggttagtcgtaatgctgacaaaaccgatcgaaatcatcaaaacagcgccgatggtaaagctacaacgacgcgcattgatcgtggtcatgtgcatcttttccatgaagaacttcgccaggaaaccgcctgcaacgcagccgaagtccgccgccaggaacggcagccaggcaaacatggcgatctcttttaacggcagatgcatcacgttaatcagatacagcggcatccagaaactcagcgttccccatgccgggtcagcaagaaaacgggtaatcgccaatgcccagaagttacgctttttaacgatctctttaacggccggttttttattatcgtcctggagatagctttcctggccgtcttcgatataacgcagctctttgtgggtgatccacgggtgtttatttggcgagttataaatcaggaaccaggtgatggcgaacagcacgccgatcccaccggtaatcacaaacgccatttcagtaccgatgccgctatcagcaaaggtcagcatcgcccagaccaccagcggcggcgccagcatcgcgccaattgaagtaccgatattaaacaggccccccgcaataccgcgttctttcgtcgggaaccattcggcgctggctttaatcccggccggaatcgctgacgcttcggttagccccatcagaccacgcagaaatgccagacttatccagccgccggccagcgcgtgcgccatgttgatcagcgaccacaacaaggcaaagataaagaagccgattttcagtccgatgacatccatcaaatagccggtgatcggctgcgcaatggtgtaacaaagctggaaggcgctcaccacccaggaatattgttgctcatcaaaatggagttctttcatcatcgctggcgccgcaacgctaagcgagctacgggacaggtagtttacgatggtccctacgcagaccaggccgataatccaccatcttaattttgtcatcttcatgataaagcctcgttaaaaaacattagctccgcgccgtctgacctgtagcgggaaaactgaaatcacaaaaattggttgaccaatcaatattttctcatccggaccggtcaaaatctggcggcaactcccgcctttaatattcttgaaataaatacatcaactcatttcaagttgaatggtgaatgctttccacccagcaaaaattgacacagatcaaataaataaaattggcagaccgtgaatgatgatatttgtgatttggttagccaatttagacaataaggttgacatgagaaaaattttggttgaatttagggggcagaacgggtttacaaagcacgtttcgaagttggctggcaatgggtcaaccacgaagacgttatcgcaagaagaggaaacgagatatgaaacaaacctggcgctggtacggacctaacgacccggtaacgctgtcagatgtacgccaggctggcgcaaccggcgtggtaacggcgttacaccatatcccgaatggagaaatttggtcggtagacgagatccagaaacgtaaagctatcgttgaagaggcgggtctggagtggtctgtggtagagagcgtacctatccacgaagatatcaaaacccacaccggtcagtacgatttatggatcaaaaactaccagcaaacgctgcgtaacctggcgcaatgcggtatctatacggtttgctataactttatgccggtactggactggacacgtacggatctggaatacgtattaccggatggttccaaagcgttgcgttttgaccagattgaattcgccgcgttcgaactgcatatcctgaagcgtccgggagcagaagccgactatacggcagaagagattgctcaggcagagcggcgtttcgccaccatgagcgaggaagacaaagcacgtctgacccgcaacattattgccggtttacctggcgcggaagaaggctatacgctggatcagttccgtcaacacctggcgacgtataaagatatcgataaagcaaaactgcgtgaacattttgcctatttcctgaaagccattattccggttgccgacgaggttggcgtgcgtatggccgttcaccctgacgatccgccgcgccctattctcggcctgccgcgcattgtctctaccattgaagacatgcaatggatggtggaaaccgttaatagcatggcgaacggcttcaccatgtgtaccggatcttacggcgtgcgcgccgacaacgatctggttgatatgatcaaacagtttggtccgcgcatctactttacgcatctgcgctctacgctgcgcgaagagaatccgaagaccttccacgaggccgcccatttgcacggcgatgtggatatgtatgaagtcgttaaagcgattgtggaagaagagcaccgtcgtaaagccgaaggtagcgacgatctgatcccaatgcgcccggaccacggtcatcagatgctggacgatctgaagaagaaaacgaatccgggttattccgccattggccgtctgaaagggcttgcggaagtccgcggcgtcgaactggctatccagcgcgctttctttagcaaataaccttctttcgcatggcgcgacgcgtcatgcgatttcccctactcaatgcaatagcaacatgcctcgccccggagatcgcgggcgaagacgtcgaatgacaggagtttgcaatggaacagaatatcgccaccgcccaggtttccgtcgcccgcccaaactgggacaaatcacgtctggtatcccgtattgtgcatctgggctgcggggcgtttcaccgcgcgcaccaggcgctctttacccatcatctactggaaaagagcgacagcgactggggcatttgtgaagtgaacctgatgccgggtaacgacgcgcggctgatcgcgaacctgaaagcgcaaaatctgctgtacaccgttgcagaacgcggcgcagaaagcaccgaactgaaaattatcggttcaatgaaagaagcgctacaccctgaattcgacggtcatgcagggattctggcggcaatggcgcgcccggaaaccgccatcgtctccttaaccgtgaccgaaaaaggctactgcaccgaccccgccagcggcgagcttgatgtcaataacccgctgatccaaaacgatcttgcccatccacagcagcctaaatccgccattggctatattgtcgaagcgctaaacatgcgccgggagcaaggactgaaagcttttaccgtgctgtcgtgcgataacgtgcgcgagaatggtcacgtcgcgaaggctgccgtcctcggcctggcgaaagctcgcgatgccgccctcgccgcatggattgccgacaatgtgaccttcccctgcaccatggttgaccgcattgttccggcagcgaccgaagagacgctacaactggttgccgaccagttaggcgtttatgatccctgcgctatcgcctgcgaacccttccgccagtgggtcatcgaagataactttgtgaatggtcgcccggactgggataccgtcggcgcgcaattcgttgcagatgtcgtaccgtttgagatgatgaagctgcgtatgcttaacggcagtcactctttcctcgcctatctgggttatctcggcgggtatgacactatcgccgatactatgactaacccggcttaccgtcgcgcggcgctggcgctgatgcttgatgaacaagcgccgacgttgtcaatgccggaaggcaccgatctggaagggtatgcgaatttgttgattgcgcgtttcactaacccctcgttgaaacaccgcacctggcagatcgcgatggatggcagtcagaaactgccgcagcgtttgttggacccggtacgtctgcacttgcaacagggcgatgactatcgccgcctgacgctgggcgtcgccggatggatgcgttatgtcggcggtgtcgatgagcaaggtaaaaccattgatgtcgtcgatccgctgcttgcacagtatcaggcgattcatcagcaatatcagacgccggaagaacgcgttcgcgggctactggccatcgagtctatctttggcaacgacctgccgaagaaccacgaatttgtgcaagccgttaccgacgcttaccaacagctattgcagaatggcgcgaaagccacggtagaagcgctggctaagtaaggagataaatcatggctacgtttatgactgaagattttctactgaaaaacgacattgcccgcacgctgtaccataaatacgccgcgcccatgccgatttatgacttccactgccatttaagtccgcaggaaatcgccgacgatcgccgtttcgataacctcggtcagatctggctggaaggcgaccactataaatggcgagcgctacgaagcgcaggcgtggatgagtcgctgatcaccggcaaagagaccagcgattatgaaaaatatatggcctgggccaataccgtaccaaaaacgctgggtaatccgctgtatcactggacgcaccttgaactacgccgtccatttggcattacaggtacgctgttcggaccggataccgcagaaagtatctggacgcagtgtaatgagaaactggcgacgccggccttttccgcgcgcggtattatgcagcagatgaatgtgcggatggtcggaaccaccgacgacccgatagattctctggaatatcaccgccagatagccgccgacgacagcattgatattgaagtcgcgccaagctggcgccccgacaaagttttcaaaatcgaactggacggctttgtcgattacctgaggaaactggaagcggcggcagatgtcagcattacccgtttcgacgatttacgtcaggcgctcactcgccgcctcgaccatttcgccgcctgcggctgccgcgcgtcggatcatggcattgaaacgctgcgatttgcgccggtgcccgacgacgcgcagcttgacgccattctgggcaaacgtctggctggcgaaacgctgagcgaacttgagatcgcccagtttaccacggcggtgctggtctggctgggccgccagtacgccgcgcgcggctgggtgatgcagctacatattggcgcgatccgtaacaataatacccgaatgttccgcctgctggggccggataccggctttgactccattggcgataataacattagctgggcgctctcccgtttgctcgacagtatggatgtgaccaatgaactgcccaagactatcctctattgcctgaacccacgtgataacgaagtcctggcgaccatgatcggtaacttccaggggccgggaattgccggaaaagtgcagtttggttccggctggtggtttaacgatcagaaagacggtatgctgcgccaactggagcaactgtcgcaaatgggactgttaagtcagtttgtcgggatgctgaccgactcccgcagtttcctttcttatacgcgacatgaatatttccgtcgtattctctgtaacctgctgggacagtgggcgcaggacggagagattcctgatgatgaagcgatgctaagccgtatggttcaggatatctgcttcaataatgcccaacgttatttcacgattaaataatcgctattaatctgtgagcacaggtttcaggtattttgagaggcaggaaggcggtaagagagtgagaaatttagcagtaacgcacttttccagccaaagtctggccgccgataaaaagcaaagaggttactgattaatcccgaatcacttactaaggtaagtgattcgggtaaacaaacacagccatcttctgcgtcatgctttttttctctgtccggaataactccagtgcagaaagagtgatacatcagtcctgttgatgatggatcctgtgggttatacggtaataacttatgacttcacagtgtggtttcttttaacaaatcgacagccagcatttccagctggttaaccacctcattactggatcgctccattctgtcgagttcttgcgacatcgcattcatatcgcctgcggcaaaatagttcagcgcagagtgaccagcggtatgcacctctttatgcggcgcttccagactacggaaactgtagtaattgctaaactgctgcccttcaaaaccgtagtaccatttccccagccgacactgatcgtgcatcgttattttactgtttatgtctttatttaagagtaatttgtagacttccattttccagataacatggtcaactttgacaatattcaaaaactgcaccgtagagatgtactgcatgaccgatttcatgctcagcgatttatcgatgacgatgccaatagactccacaatttgatttatgttagtcgtaatattatcaataaccggctgttggttatccagcacctcactcactctggccgtattatctttgattacagaggttaacgtactgacgcttttcgaactgtgtttaacatcttcggacaggtttttcacctctttcgaaataacgctaaaaccacgcccggcatcccctacgcgcgcggcctcgatcgcggagttaatcgctatcaaattggtctggttagcgatcttctgtatctctttaatacacgcattaatttgcgttaaggaggtatttaagtcgcccatacgacagccaatatccgatgaagtcgtgccaatttcggtgataaattccacgagcgattttaatgaacttctggctttatcattctgttcattaagttcattaatgcgttctttttcaatgttgagctgctcacaggatttaatgatggcattacgaatgatatcgatcgtcgagatccccatcagaattttttgacacagtatccgctcataaggctcaggagtatccaccaccacgtcagacgcattagcgccagattctgctgctggcggcggtattttgacaacattattattccagtggcgcaagcctaatacttttttaaacatataccattctccttattatatgtggacatcctgatctatgcctggataaagtattatcaactcatgctaacataatgaaaaatcggctgtcatctgccataaccatacgctcaccagaataagacaaaacgtccaccaaacttaaataattacaaggtaaactattcaacaataccattaatagtcatgatggaagtcgcttcgctttatacggaaatattatttacaaggctgacaataatagctgaataataattaactgcatttacttaggtgtatctatatctcggcccgaagattgcaaacagggtttaaacgcaaacttttgcaatagaaaaataacctaacgtaaactttttatatgaccaataatatcatttggactcatcaatatattatgctgtccgtttaccagccaaacaggcatgacctaaatccaaaggaatgggggcagcgtaaccagccgcaaaaagtatcgattagtcgaaaatcaggaaacggatgcgccaacgaggcgagcgtcaccgcctgcgtcagaaaagttaagaataatttgtgatattatttctcatatgttaccagtaaatggcaggctgatagcccttcgctggtaaacacaacaggcgggatatcggcacccacgccgatatcccgacgagaatgaccccgttacgctttgatgacgattaacggttcaatatcgctctcttttttaatgactaatgaatcatcgccgcgcaggcacgtaccgccgtagttaccgcccacggtaaacgtacagacctgaatatacttcccggcgaccttcggcaggcaccacaactgctgatagatatttttctgcgtggcgaacttgccgctggttttatccagtagctcttcctgatggctcaccaaatcgatattactaccgcaacgtccggctatcggttttaccgcatagccggtctgcaccagctcatcgttaacggtaaaatccgtgtcgagcaaatagcgatgatgcgggaacagcgaccacaggataggcaggatcgctttgttgcccgggatcaccgtccacagcggttcaaacaccaacacttccgggcgcagtaatacatcaatcagccggacttcattttccgggtgcccggtacgaataggcactgcggcatactccgtctcgctgacttcgcgtatctgctccatcgccgtttcccacgcccaggttttccagacacaattcaccagccgtccgtcgccatcgatcaactgcccggcgtcatcccagcgcaactcgcccagcccgcggaggattttgctcgcgaagccggcctgatgcagcgcctgctgcataaactgcgcgtgatagtcctcctcgatatcatcatcctgcatgatatggacgaaaggacgcgctttactgtgtttccaggcgcctgccagctcgttaattaagccctctgccgggttatgccctttaccggtatagccctgctcagcccatttttcgagaattaatcccgcttcggtatggcatgatgcggaatcggcattgtattcatagactttcagcccgcgttcatccatgcagaaatccatacgaccggtgatcatatggtgacgacggcgctgccaggagaggcgcagacgcggccaaagaattttggggatatcgaatagcgccagcagattatcgtcttttaaaactttgtccgtggcgtgcaggtacatcaaatgcaactcattggtcgctttgataagctcctgttcagcgctctcggtgatggtaaaatactggtacgggtcctgattgataacgtgcccgttcgcctgtacataggctttttgtaacggatcgcgctcatccagccactgaccgtcaaactgacctttctctggcagtcttgcgccgcgaatcgccagcgactgattcgcgatgtcaggctgtgacaaactgtattgcgtgtcgtcggtctggatcatccagcctaaaatcgtcgtgtcatcaaaggtgtcgcgcagggtgtaacacccgttttctacgaccatttccagttcgcgagtccactgctgccctggcggcaatggcgtgtggataacgttttgctcagcaatacgaattttgttatccaggagttgggtgataatcgcgacgtgcccggtttcgttaaactcgccgcccttttgccagatgagcagcgccccggcctccggcgcgcgcggcgaaccgttcgggaaggcctgcaaaggcaaaatattgtcattcacgacctcgcgcagaaaacgtagcgagaagatttcccaggccatgccgacgtcagtaaaaacaacgccataattcagaaagagaaaacggcgggcaaattccacgcactgccatttatgccccatgtattcatcgtcgatgtagctacgaaaagctgcgtcgtcgtcgtcccacggatcgagggaattgtaatctgaagagtagatcgctacgccgccgggggcgtaacccaataatgtcccgaagggggcatcctgactggtggttcctttgctcatgcacttacctcaaaacaagaccgcctgagcagcctggcgtgatttcgctctgattgtctgctctgtgacactaaccggacagaggtcgacataatcatacacctcaataaggcacactgaggccagaaggttaaaatttcactcgccggaatgtcccaatcggttaaatgtccggttagcaagctgctacactgcttcaacaccaccactgtgaaggcaggtcaatatggcagataatacttatcaacccgcaaaagtctggacgtgggataaatccggcggcggcgcgttcgctaacattaatcgcccggtttccggcccgacgcacgacaaaacgctgcccgtcggcaaacatccgttacagctttattcgctggggacgcctaacggccagaaagtgactattatgctggaagagctcctggcgctgggcgtgaccggcgccgaatatgacgcctggttgattcgcatcggcgagggcgatcagttctccagcggctttgttgacatcaatccgaactcaaaaatcccggcgctgcgcgataactcacacaacccgccgattcgagtttttgagtcgggcgcaattcttgtttatctggcggataagtttggccatttcctgccgcaggatctggctaagcgcacagaaacccttaactggttgttctggctacagggcgcggcgccgttcctcggtggcggtttcggtcatttctatcattatgcgccggtaaaaattgagtacgccattaatcgcttcaccatggaagccaagcgtctgctggacgtgctggataagcagttagctcaccacccgtatgtcgcgggagaagagtacactattgccgatatggccatctggccgtggttcggcaacgtggtgctggggaatgtctatgatgcagcggagtttctggatgccggaagttatcaaaacgtacaacgctgggcgaaacaggtagccgaacgtccggcggtaaagcgggggcgcattgtcaaccggaccaacggcccattgaacgaacagcttcacgaacgccatgacgccagcgacttcgaaaaccataccgaagataaacgtcaaagttaaaccataatgccggatggggtagtaatgtcgtcatccggcatggtattccctgctgacgcttcgcttatcagttctgcgagtgcgtcatattcggcgcttcactaaacccatgttgcatgagaatcaacctcgcccgtgctgacagtaaaaagtcggcaagcgtttttccctgctcgctcaggcaggcaaagccatattcagccacgggattataaggttccgggatatcaaccactcgcagcgaattaacctgccgtagccagggagcatagctggcatagccgataaagatatcggtgtaatcatgattgatgagccattccgctgccagccggcccgccggtaacggcaaagtctgcctgccgccaaccagcgctaccgcgcgttttcggaccgcttcgccctccttgcccatccgcgaaaaaagctgctgcgtataatcgccggaaggatcgcaacctgctgttgaggtgccgatccgcagatcccgccgggttaatagcgacaaccagtcctcgccttcacgcatcgcctgtgcccgcacgctcaggcacaaacggttcgtcgtaaaaggcgcgacccgcagcgcccgcccgctttccagcagcgcctgcggatgcgccaggttcgccgaagcaaaaaagtcgcacgcttcgcccgcttcgatgcgttcacgtaacagccccgccggaccgaaatcacataccgcatccgcctgaaacgccgccattagctgcggccagacgacgcgcaagctccccgcagccagtattcgcattattgtacgccctgatagtcagtacggtaaaaacgttgataccagtcgttagcggccttttgcatgtcaatatcgtggaatttttccggatagagttttttcgccatccacagttcgccgattcccaccgcctccggcatcggatatccccaggctttggcataatccggcatcaggtaaacccgatgatgcttcaccgcgtcaatgacctgccactggggattgtgcaggatctcattgacgacctttggatagcgattctggacaaagatcacctgtggatcccaggcgatcacctgctccattgtcacctgcttaaagcctttcaccgaggatgccgctacattcagcgcccccgcatgggccatcatcagaccggtgtatttaccggaaccgtaggtggtcagctccggattcgccatataggcgcgaactcgctcattttcagggaccgactgcaaacggtcgctgaccatcttgcgacctttatccatcgcctcaatcagcgctttcgcctcttgcggtttattgacgatatcgccaatcagcgttattccttcacgcagcccgcgattataagcctgctcttcatcggccagggtcgggttcattttagcctgctcgccagcaatatcatggcgcagcgaaatcgccactaccggaatgccaagacggctgatcttgtcgatcatctcctgcggagcgtaattcgtgacaaacaccacctgcgggcgcagcgccaccagtttttcaggatcaacgtgcgttagatcgcccagcgaggctttttgcgccagttccggcgccagacgcgcatagccgtcgcctaattgctgtttccagttcgccatgaccccaacgattttgtcagtggcattcatctgtacaaggagattgagcgtttgatgctggagcaccaccactctgtcgacggtgtccggaaccgtgacctggcggccaatttgatcggtaaaagtacgcgccgcctgtgacattaacggccagcaaaaaagcaacgccagcagagagagctggcgcaaaaatttattcataggtttcgccccataatcgatatataaataattatataacgattatagagcgatataatagaggtgattaagggatcacgcgctggtgatgtcgtactccatgcggcgcagcgcatctaacgtggctttcgcttcgtcttcgtcaatgatgctcatggcaaaaccaacgtgtaccaatacccattgccctatcagatcggctggcttaccttcacaaatcagagcaatattgacatcacgtttgatgccacacacttccacctgcgcaagctggtgaatatcatctccgacggccagcacctgaccggggacgccaatacacataattaaccacctgaaataaaatgcgggttattcgacctcaatactttttactttcaacgaatcgccggtatccacccgcaggcgatcgccatgacaatgcggacattgcgcgtcatgcctgagaatttccaccacctgactgcaatcccagcaccaggcctgggccggtctgtagtcgatgtgcaattcgcacccttgcgctaaagtcccctggcaggcgatatcaaaactgaaacgaaccgcgcgctcttcaacgcacgaaagcgcgcctatctccagccatacgccggtgacgcgcgccacgccgtgctgttctgcctgctgctgaataatttcaacggcgctttggcaaagagacagctcatgcattctcacagctccgacggccaaacagcaacgcacgccggcttgtctgcggcgcatcaggattgcttaccggcagagataacagcatccgcgcgcagtcatccgccagccggacgccctcttccggcgacaggctacgggaaagcggcgacatcaacgagcaggcaagatattgcgaaacgccttccagttcgccaacggtaaaggtcatcgtgccataaggcagttgcagaccgagtttttcaccgacggtacgcctgggccagatctggtccgggccagggaagattaatgcgcttaacatccacggcgtaattaccgtgcccgtccattgtccttcaaataacgtaaaatcagagacatgcactggcatagtcggatgcagaaacgaaagatcgtgcatcgaacgatgggctatctcttcaaacgccgcctgaacccgggcgacgggcgccgtgtcgaatccggaaaacgtttcagacatgcgccgtctccttaggaattgcttcgacgccggattcacgcagcgcagcaagaacctgctcaagcgcaggctcaatcatcgcctcgacggttggcgttaagccgatgtgcggttccagcgactgtggaataacgccaaccagggtcagtttcttcggaaactcgccggtaaagcggagggccgacaatacgtcggccagtccaagctgatggggggagattttgttggtgaacagcgccggaacttcatcgtcgcgcagtaccataatggttcccggcgcgttctttttcgacacgatggcgtcggcaatgatcaaatgatcacgattcgccatatcgccaagaagttccattcccgccgtaccgccatccagaatctcaacgaaatccggcagggtgtatcgttgctctaacgcttcaacaatacgcaccccgatggcttcatcggtcagcaaaatattgccgacccctaagactaatatccgcattacaaaaccttcaccgagaccacttcattgccatcggcgtccaccacgtgtaccgcgcacgccatgcaagggtcgaaggagtggatggtacgtaccacttccagcggcttcgccggatcggcgatcggcgtaccgaccagcgactgttcgtacggccccacgtcatcgttgaagttacgcggacctgagttccaggtcgatggcaccactgcctgatagttactgataataccgtctttaatcaccatccagtgagacagcataccgcgcggcgcctccaggaagcccacgcctttgaactcgcccgtcgccggaatgttcggcttcacaaacgtggtgtaatcgcctttgccgatatttacaatcagcgcgttgtattgatcctgcaatatgttttgcagttcacaacagtgaacggtacgcccgatgatacgacccagcgtagagtgaagttgcgccatttccagcgttttgccggtcagcttctgataaagcgcaatgatttcattgagcttggtctgcgtggattcacgacctgcagccagtttacacagcatgttcgccagcggcccgacttcgacggttttgccgtagaatgtcggcgacttgacccatgagtatttaccgtcatccgaccaaccgtcgtaagccgggatcgtagtgccttcccacggcgcctgcggcgcttcatctttgtaccaggcgtgcttcgcgctctcctgaatacctttaatcaggaactcgtcggagtgagaggtgatcggacggtatgtcgacagatcggcattggtaatgtaaccgcccgggaacaggaaactgccgtttttaccgtcggtcgggaattccggcgcgctcaggtagttcaccgcgcctttgccacgctccagccattccggatagtaggccgcgatgactgcggtatccactttatacacctgctcgacaaaatcgctcagcttatcaataaacgatttgatgtacatcaggcgttcaaggttcaacgtaccgatgctgtcgagattgatcgggttcgccaccccaccgaccgccaggttctggatatgcggcgatttaccgcccagcaacgccaccacgcggttagcgtcacgctgacattccagcgcctgcagatagtgagcgaccgcaatcaggttgacctccggcggtaactgcattgccgggtgcccccagtagccgttggcgaaaatacctaactgaccgctggcgacaagatccttgatcttgttctgaactttcgtgaactcttgcgcgctgttcaggtgccagctcgacacaccatccagcatcgcggaggctttttccggatcggctttcagcgcagaggtaatgtccacccagtccagcgcagagagctggtagaaatggacaatgtggtcatgggtggtatgcgccgccagaataatattacggatatactgcgcgttgacgggaacatcaatattcagcgcgctttccgccgcacgaacggaggagatcgcgtgagttgtcgtacaaacgccgcaaatacgctgcacaatcatccacgcatcgcgcggatcgcggttcttcacgatctcttccataccgcgccacatggtgccggacgcccatgctttggatacgacgccgttctcaatttcgcagtcaatgcgtaaatgaccctcaatacgggttaccggatcaatagtaattctctggctcatgctttgctcgcctcatgacgattatgatcgttttgttttaaaggaggaagtatcggcagtagacgaatgagtacgatgtatgcacaaatctcaatggccacaaaaccaatagaaatcaacaattcttcccaggttgggaagtagtggtagccgccacccgggttgaatgccaccagcgaataggtcagacgccacgtcgcgcagcccaacagcgcgctcagcgccgacaggtacagcatacgagagtcattacgcagtttcgccacacgcagcaccactaacgggaagaccatcaggacgacttcaatccagaacatagcggagtaaaaatcgccggcaaacgcataggacagcttgtcgcgataaatcagttcgccaaagcgcaggacgacgaaaatcgccagcagcacgctgatggtattcgtcagcttaacaaacaaatttttctcatccggaccgtttcctttcaggcctgcctgaaccagcgaaccctcaaatatgacaatggagaagcccatgataaacgcggtcagaaccgagaacagcggcagcatttcatagctttgccatagcggatgcactttatagcccgccgagatcatcaatgaccccattgaggactggtgcatcgtcggcagcagcgcgcccagcgcgataataaagaacatcaccttattcagacgcttgagcgacactttccagcccagacgttcaaacagggcaggcgcaaactccagcgccatcacgccgatgtagatggtcatacagaccgccgtctcaaacagtaccgagttcacgttgaagtgacctggaatgtagaagtacggcaggttccagtaacgaccgacgtcgatagtgatcgacaggccgcccagcgagtaaccaaacaagcttgccagcaacgccgggcgcaccaacggatggtattgcccacggttaaagacatacaccgcccatgccaacgcccaaccgccgcaggcaaagccggtgccgatcaacaggtcaaaggcaatccagacgccccacgggaaaccgccgttcaggtcggaaacggagcccaacccgaagaccagacgcttcacgataaggagcatacacaggacgattaacggtccaaaaataatgaccggtttactgatgatttttccgcccagcggttttggatcatgactcatgatcgtctcctccatcgtgatggtcgtttttgctattacgacgaaccagcacggttaagcccgccagcgcagccaggggtagtatcatgcctttataaagcgtgtgttgaacatgctcggagcgcgctccggttgaaaggtcatccagcttcggcagatccagatcttcataaggaacgcctgtcagcaccagcacctgagtaccaccgccctctttttcaccgtagaggtgtgggtagtatttaggcaccgtatgcagataggtgtcgtccgttttcaacgtctggcgcggatagtgatattcactgcctggtttgagggccagacgttttttcgcttccgccatcagctcttcacgagtaccgaaaatgacggcccctgccggacaaacttccacacacccaggcaaaccgcctttatccagacgctcaacgcctttctggttacacaactcacacttgtgaagcgcgccaaacgggttgttgtagtcgtacttaggtacgttgtacgggcaggcaaccatacagtaacggcagccggtgcagacatctttgtcatagtggacgatgccggttttcggatcttttttcagcgccgacaccgggcaaacggaaacgcagttaggatcgacgcagtgcatacactgtttcttgatgtaggcatagccgttctcttcctgatctttgttcacgcccgtaccgctacgccatacctgaataatgttattggtatacggcgacagcttgtcgttgttcgaccaggtctgctccccttccgggttacgcgccgggaagttgatatcctgacactttgtgacgcaggcctgacagcccacgcacagagtggagtcatacagcatacccagcgaacctggaatcggcggacggttttctgcagccgcatggctgacagacggcgcggcgcccaacagcaatgctccaccggaggctgctttaataaagtcacgtctgttcacggttattctccccgtgagtcagcgttatctttcttttgctgacgccccagttcacgtaccgccatcacgctgacgccggcaaccagaccgactacgccgccaagcagaccgacagcgcccgcagagatattgccgccttctttcatattgacgtcaggtttctctgaacgcggagtttggttttcgacatgagcaagctggtgaatgcccttatggaagccgataccttcttcgttacagccatagcaaggatgaccgatcgccactggccagacgccgccaacgtcacagaactgtaacgtagaacagttgccccaggtttccggccctttacagccaagatggtagagacaccagccctgacggtggccttcgtcgccaaattctttggcaaaacggcctgcgtcgaagtgtggacgacgttcgcaatgctcatgaatcagacggccataggcaaaggttggacgatttttcgcatccagcttcggcggcgtgccgtaagtgatgatatgcgcgacggtcgccaggaagttatgcgggtttggcggacaacctggaatattgataaccgttttgcccggtaagacttcctgcagactgacagcgccggttgggtttacgccagccgcagcaacgccgccccatgccgagcaggaaccgatagcgataatcgcggctgcgccatcagcggctttgcggatgtgatccacgatcggctcgccggcaaccatgcagtagataccgttatcttttagtgggatagaaccatccaccaccagaacatattgccctttatacttctccagagcgttatgtttgttttcttcgacctggtgaccgaatgcggcggaaagcacctcgtggtattccagagagatggtctccagaacgaggttttcaacggttgggtgtgtagcacgaagcagtgattcggtacaaccggtacactcctgagcgccaatccagataacgggcggacgctgtggattggataccgattctgccatttctgcggcggctttgctactgagccccatagtagcggccagtgctgcacaaagcttcatgaaatcacgacggttaatgccgtgagaagtgatgagagtattatctccagtcattttatagttattccgttacgaagacctggcttttattttgcactgttcgcgaagaagttattgcgatcggtacgccatttaccacactttttttatggttatgtgcgccataatacttcgacggaacagtaaaacgaagggaagaggcgatagtgtaattaattaaagcaagataatacccctgttggatcaaccttcgagtcgataaccggccataaagaagcgaaccgccatcccggaatgattctctttaaagaaatccatcaccatttctttatccagaccatagcgacgcgtcagaattccagcctcccacgcgctaagttgacgatcgccggtcttttcgaacatacggtgtgtaaaacccaatacaaagccacgtttatactcagaacagaaattcaccgcatgatgcgcgctatatgcatatggcgcgtgcaacccggccattaaccctttcccaaaatgattattcatctgacctccttagtcgctatataataaattatatagcgactaattaaatgaaggccagcgcattacgcgcttttttgcttcacatcagaaggaaacccattcatcagtagactgtgcgggagccgacgccattctctgaacgccaggcgccgctttcgccgttacgcgttgttgcggctcactagcggaaagccggaactgctgtacggagcgttgcaaatcctccgtctgccgttccagcgccgccgccgccgcggaaacctgctcaaccagcgcggcgttttgttgcgtaacgctatccatttgcgtgatcgccacgccaacctgagaaatacctttactctgttcttcggaggcggacgcgatctgtttcataatcgtcgtcacttccgtgacgccgcgcaggatggcgtccatcgtcgcgccggtctcctggaccaactgcgcgccctgcgctacgcgacgtaccgattcgccaattaaggcttcaatttctttcgccgcccccgcgctgcggctggccaggttacgtacctcaccggcgaccaccgcgaagccgcgtccctgctcgcccgctctggccgcttctaccgctgcgttcaaggccagaatattggtctggaaagcaatactattaatcacggtagtaatttcggcgatctgctgcgaactggcggaaataccgttcattgtttctaccacatcggaaaccagttcaccgccttttcctgccgttagcgaggcggcatccgcaagctgactcgcctggcgagcgtgttcggcgttcattttcaccgttgcggtaagctgttccatgctggcggcagtttcttccagcgcggcggcctgttcttccgttcgggaagagagatcgttattaccggtagaaatttccgtcgcgccgcgccagatattgtcgcttccggcgcggatcgtactcacggcttcgcgtaaactgtcctgcatcgcgcgtagtagcggcaccaaccggcctacgcagttacgccccaacgcttcaatcggctggctaagatcgccttgcgcgatgcgctgaaactgctgacggatgcgctccagcggtttcaccatcattgcaaccagatagcgatcggtaaaaatcaggatagcaatgcccagaatcaccgccgtgataagcaggatgcggatggtataggttttaccatcgaccatcacacgtgtgttatccagcatggcgccagcttcatgactaaaccgttccgcgctggcgccgaacgcgcgactgagtgcgggcgtgaccgtactggcatgttcgctccaggcggtcagcgatccttgctgcgccagttgcatttgaggaacgacgcctttctccagcaaggcctgccagttggacaagacctcccttgagatatcagggttcatcggccctggcgatagcgctttcatctcctccagcttctgacgcatattctcgagcgactgccgggcgggcgcaaaatcgggcgtgccgccgccgatttttacatccatcgcgcggctaaggcgggtaacaaagcggaaatattgatcgttaccctggcttagcaccgtcatttgccgcacaagatgccggtcaatatcatttccttccgaaacttcggataaagcatggacgctgtataaccccacccccgaccagagtagacaaaaaagtcccagtatcgtcagcatgaccatacgaatagtaaagttttgcagcaaacgcatatgaatttccttgctgaatataagagattagtcatcagacgatgacgcactctcgttatcggcaaggcgcggagaatatataatgcattctccatttttttacagttaccgccgtttacgtacccgcagatgttatatatctgtgaacgcagagaaaatctttcagtgttattactgagtaaatgaatagatgtagtaaaaatattgcgtaaggctgcagggagacggttatccaccgttaaagaagcgctgttttacagccgggctcagcatcctttgcccgactgccccgccgttgacggcggctcaatggttatgccgcgtcaatctgtccagatagcccatcacaaacgccgacaggacaaaggtcagatggatgatgacataccacattaatttgttatccgggacgtttttcgcgtccataaacacgcgtaacaggtgaatggaagagatagcgactatcgatgccgccaccttattttttagcgacgtcgcatccattttccccagccagttcagcttctccttgcccgcagagatatccagctgagagacaaaattctcatacccggagaacatgaccattaccagcaatccgccaaccagcgtcatatcaaccagcgataacagcaccaggatcagatcggcctccgccagggcaaaaacgttcggcagaacgtgtagaatttcctggaaaaattttagcgctaaagcgatcagcgccaaagagaggccaaaatacaccggcgcgagcagccagcgagacgcatacattacattttcaagaaagcgttccatagggacctgtcaggtaactaaaaccagcaacagtatatctcaaccatgcaacatcagatcaacatgccagttaagagcctatcccaccaggcgttattggcgcagccagtttggacacggacagcgcgcaaaaaccggagcgtacacgtagtacgtgaggtttgactcgctacgctcgcccttcgggccgccgctagcggcgttcaaaacgctaacgcgttttggcgagcactgcccaggtccaaaatggcaagtaaaatagccctaatgggataggctctaaatctcatccgggttaacctgcgggcgctgatattccggccataccagcgcgaccaatgccgggtaggcttcaagactgaactcgcgaaaacactggcgtaaattaaggacgtccaaatccgaatacggcaccttttctccgttcagacaacgcttctttatattgtcgtaatacttataaacggcagagttaaggtcgctgcaacgacgctgtgcgtcaaataatccaggcgtttcattcaactcagtcattgtcattcgttttatcgttgcatgaaggaaatcgatatattcatggttaacgcgccagtaccataccggcgttatcgaattcattaatactgagaaatgatcttcgccctcttcctttgtcatgggttcagtttgatttaaatttacgatttttccaccaggacgttttttattaacctcccacatcaggaagagtatcgcgccggtcagtaatagcaatataataacagaataaaaaatactgttcatagcaggctccattttttttgattttaaaattacgccatgttattgtcaacgaaacctacactattaaaaatagtataccactgatcgtaaaggatatttagtcatgcttcctgagcatctggtttcctctcattttcgcctgtcatcgccgccccctgaagccacagaaaacagtaaaaatttgcctaagggaaagacaaaactcagcgattacgagcccgatattttaattagcgctaacgctgccgggcaacacagaaacgtattatttgaagaacgcgaccgtcatattaaagaacgtctgtattgtgtggctaaaattgaaacgtttgcccgcctgataaacgcactacaggcagaaggcgatattgatgcccaaacgctaagtaaaatactggcggataaaaccgcaatgataaatgaaaaaggcaatgccatttggcttaatttaatcactcgcgaaaccgatatgccgctattttattcactggaagataaagatgaaagaagttgaagacaataacgtttatttggctttagacaaccataaaagtgatgaatttatcttaaagcaaaatcttgcagcactaatcgccagcaaaaatgccaccctggaaaaggtaacgcaggaggtggtatccataccggcggcgttagtacgcctgaagtggcaaaaccgacgggagatgtatgcgttacaggtcaaagaggagatttatggcgcgaccatcaatgccattatcgagcagcatcctgaattacgagacaaaattatgtctcgtcttgaaagtgactggcagcatctgctggctcgcgagacggcaaccttacgtctgacgcgtaagctttccgatggcgactaccggacgcgcaacgtcaccaccgtcgcacggcaagaaaaataaccttcatggctagttaactctgttgtgaatacgggcgaagcataaggatcgttctgattctccctcttacggtagtaaaagtgtctacgcttaaagggtgttcaacctgaagggagaagctcaatgtctcatctatacgaccctaccacgcagtattacaccggcgagtatcctaagcaaaaacagccggcgcccggcgtccaggcgaaaatgacgcctgttcctgactgtggtgaaaaaagttatgtcggcagtggtcgccttaaagatcgtaaggcgctggtgacagggggcgactccgggattgggcgcgctgccgctatcgcttacgcgcgtgaaggcgcagatgtcgcgatcaactatctgccagcggaagaagaggacgcccagcaggttaaagcgctgattgaggagtgcggccgtaaagcggtgttattgccaggcgatcttagcgacgaatctttcgcccgttcgctggtccataaggcgcgtgaagcgctgggcgggctggacattctggcgctggtggccggtaaacagacggcaatcccggagataaaagatctgaccagcgagcaatttcagcaaaccttcgccgttaacgtttttgctctgttctggataacccaggaagcgattccgctgctgccaaaaggcgccagtattatcacaacgtcgtctatccaggcgtatcagcccagtccgcacctgctggattatgcggcaaccaaggcggcaatcctcaattacagccgtggcctggcgaaacaggtggcggaaaaaggaattcgtgtgaatattgtcgcgcctggccctatctggacagcgctgcaaatttccggcggtcaaacccaggataaaattccgcagtttggtcagcagacgccaatgaagcgggccggccaaccggcagagctggcgccggtgtatgtctatctggcaagccaggaatccagttacgttaccgcagaagtgcacggcgtgtgcggcggggagcatttaggctaacgcatgaagtcgattaaggtggcgcaattctgttaagcaaggcgccactttaggcaataaaaaagccgggtggcgacttcgccttacccggcctacagcgtcagcagaatacttatttcgctttcgcggtctcttcgccgaccagaccaatcttgagatagcccgcctgatgcagcatatccatcactttcatcagggtttcatactctacggttttatccgcgcggaagaaaatcgtagtatcctttttcccttccgtcagggccgttagctcggcaatcatcgtatcatccgtcaccggatcgttaccgataaacatggtgttatccgctttcaccgacagataaaccggtttttccggacgcggctgtggcgtactggtagaagcgggcagattcaccttgacgtccaccgtcgccagcggcgcagccaccataaagataatcagcagaaccaacatgacatcgataaacggcgtcacgttgatttcatgcatttcgccgttgtcatccaggttctcgttaagacgcattgccatgacgcattaccctacccgtaatttctgcgcggcgcgtaccggctgcgcactggcgctcgcattcagatcaagatcgcggctttgcagcagcaatacctgcgccgccacgtcgcccagcgtcgctttgtaactgcctatctgacgtgcgaagatgttgtaaatgacgaccgccgggatcgcggctaccagcccaatcgccgtcgccagcagcgcttccgcaataccaggagcgaccaccgccaggttggtggtctgcgtttgcgcaataccgatgaagctattcataatgccccatacggtgccaaacaacccgacgaagggggaaatggcgccgatcgtcgccagataaccgttgcctcgtcccatgtagcggcccaccgctgcgacgcgacgttccagacggaagccggtacgttctttaatcccttcgttatcttcgctgccctgagagagttccagttcattctgcgcttcattgatgagctgtgcgctgaggctttttgcgctgaaacctgccgcaatgtcggaagcctgatctaaagagcgcgcatcggctaattgcagttgttcgcgctttaagcggcgcttttgcgtgaaaaattcaacgcttttactgaagaagatagcccaggtgacgactgacgccagaatcaaaccaatcatcacgcacttcacgacaatatcggcgtgctgatacatgccccagacggaaagatccgtctgcatcaaattattacccactctgtatctccaggacgcaaatcacaaaatctgagcataataatatcaaaacaacgtcgaattgatagtcgttctcattactatttacatactgccgcacctttactgctttttctttgcgcttacgcattaaaaaagccacctgtttttattttggcaaaattttcatctgtatcacacgtcgccagggtgcagatggttatattcatgctagtttagacatccagacggttaaaatcaggaaacgcaacatgacggataaacagttggataccaaactggtaaacgcaggacgcagcaaaaaatacacgcttggctcagtgaatagtgtgattcaacgcgcttcttcactggtgtttgacaccgtcgaggccaaaaaacacgctacccgcaatctcgccaacggcgaattattttacggacgccggggaacgctgacccacttttcgctccaggaagccatgtgtgaactggaaggcggcgccggatgcgcgctcttcccgtgcggcgcggcggcggtcgccaacaccattctggcattcgttgagcagggcgaccacatcctgatgaccaacacagcttatgaacccagccaggatttctgcagcaaaattctcggcaaactgggcgtgacgacaagctggttcgacccgctcatcggcgctgatatcacgcaacatattcagccgaacacgaaagtcgtatttctggaatcccccggttctattaccatggaagtacatgatattccgagcattgttagtgcggtcagacgcgtcgcgccagaagccgtcatcatgattgataatacctgggcggctggcgttctgttcaaagctctggaattcgatattgatatctctatccaggcgggcactaagtatctgattggtcattctgatgcgatggtcgggactgccgttgcaaatgcgcgctgctgggaacaattgcgggaaaacgcctatctgatggggcaaatgctcgacgccgacacggcttatatgaccagccgcggtctgcgcacactcggtgtccgactgcgccagcatcaagaaagcagcctcaaaatcgccgcatggctggcgaaccatcctcaggtcgcgcgcgttaatcatccggccctgccgggtagcaaaggtcatgcgttctggaaacgagactttacaggtagcagcggcctgttctcctttgtgctcaataaaaagctgaccgaggcagaattatcagcctatctggataacttttcgctgttcagtatggcctactcctggggaggctacgaatcgctgattattgctaatcagccggaacagatcgccgcgattcgtcccgcaggcggcgtagattttaccggtacgctggttcgggtgcatattggtttagagagtgttgatgatttgatcgctgatttagccgccggcttcgccagaattgtgtaaagttgccggggatggacatatatgcagacaatttccgtggaaaagtctgcgtttgttgcgtccgggatcaaggcatcccggacgattcaggagtacaataggcgaataaaagcataaatgctgttccacaggaaagttcatggctgtcattcaagatattatcgctgcgctctggcaacatgattttgccgcgctggcgaatccacacgttgttagcgtcgtctactttgtcatgttcgccacgctatttttagaaaacggtctgctgccagcgtcattcttacctggcgatagtctgctgctactggcaggcgcgttgatcgcccaggatgtgatgcattttttgccgacgattggcattctcaccgccgcggccagtctcggctgctggctaagttatatccagggacgctggctcggtaatacgcgtaccgtcaaaggctggctggcgcagcttccggcaaaatatcatcagcgcgccacctgcatgtttgaccgtcacggtttgttagcattgcttgccgggcgctttctggcgtttgtccgcactctgctgccaacaatggcgggcatttccggcctgtccaaccgccggtttcagttttttaactggttaagcggcctgctgtgggtgactgtcgtgaccagcttcggctacgcgctcagtatgatcccgtttgttaagcgccatgaagaccaggtaatgacatttttaatgatccttcccgtcgcgctactggtcgccgggctgttaggtacgctggtcgtggtgattaaaaagaaatactgtaacgcctgacgtatccataatcggccaggatggcccggttacgcttcgttgacccgtggcgggatgccccacttagctcccttgcattgtccgcattcttgccacatcttcgcccggcgtaacgccaaaataacgtttaaactcccggctaaactgcgatgcgctctcatagccgacccgcatcgccgcggcgctggccttcataccgtcgtgaatcatcatcatccgcgctttatgcagtcggtagctttttaaatactgcaacggcgaggtgctggtgaccgccttaaaattatggtgaaacgccgacacgctcatgttcgcttctgccgccagttgctcaacattcaggttctcggtgtatttcatttcgatctgtttaagtacgcgactgatcaggctaaagtgcgtctggcgactaaccagcgcaagcagcgccccgccgcgcggccccatcagcacatgataaagaatttcgcgaataatctgttttcccagaatccgcgcatccagcgggcgctccatcacatccagcaatctttccaccgcacataaaatctcgtccgacagcgtggcggagttaatcccactggccgccatcggcaactggaaacgctcatcttcgccaatgtccatgagcaactcttgcagttgcagcacatcaatatcgagccgaataccggccagcggtacctccggcgtcgcccaggtctcgcattcaaaagggagcggcacggtcagtaagagatattcattagcgtcataacgaaacttgcgcttgttaatatagccaattttatggccggaaaagagaaatatgatgccaggctgatacatgaccggcgtgcgcggccccggttcaacaccatacaacagacgaatgcccgccagccgctcgctgattattttatcattattttttaaatgattaattttatccgccaactgtaagcaaattgcttcacgattcataacgcgccattttttcatcaaatccactccgctggattgtgcgcatttttagcgattttctccagcattctggagaaataggcaaaacattggcagaaatgtgcattgagagacatccctcacaagaccacaatgatgaccatcaggcagacagccgcctgccctctttttacccacataagggaatgagcaatgaacaatttcaaattacatacccctacccgcattctgtttggtaaaggcgctatcgtcgatcttcgcgatcaaatcccgcaggacgcccgcgtgctgattacctatggcggcggtagcgtgaaaaagaccggcgtactggcgcaagttcaggaagcgttaaaaggactggatgttcgggagtttggcggtattgaaccgaacccgtcctatgaaacgctgatgaaggccgtgcagcttgtgcgcgacgaaaatattaccttcctgctggccgttggcggcggttccgtactggacggcaccaaatttatcgccgcagcggcgcagtatacggacggcgtcgatccgtggcacattctggaaaccggcggtactgagattcgtagcgcaatcccgatggggtctgtgctgaccctaccggcaaccggctcagaatcgaacgccggcgcagtcatttcccgtaaaaccactggcgacaaacaggccttccactcctcgttcgtgcaaccggtgtttgccgtactggacccggtctacacctatacattgccgccgcgccaggttgcgaacggcgtcgtggatgctttcgtccataccgttgagcagtacgtcacttacccggttaacggcaaaattcaggatcgtttcgccgaaggtattttactcacactgatcgaagaaggtcccaaagcgctgcaagagcctgaaaactatgacgtccgcgctaacgtgatgtgggccgctactcaggcgttaaatggcctgattggcgctggggttccgcaggactgggcgacgcatatgctgggccacgagcttaccgcgatgcacggtctcgatcatgcccagacgctggctatcgttctgcctgcgctatggaacgaaaaacgagacgttaaacgtgcaaaactcctgcaatatgctgaacgtgtatggaatatcaccgacggttccgacgacgagcgtattgatgccgccattgccgccacccgccgtttcttcgaacagatgggcgtgcctacccacctgtccgattacggtctggatggcagcactattccggcgctactggctaaacttgaggcgcatggatgcataaatttaggtgaaaatcaggatattacgctggatgtcagccgtcggatttatgaagcggcgcgctaaggttttttcgcctctgactttcgtttttggccatttcgtccagacttaagtcacttagtctcgccggacccgactccggcgagccaattaaaagaggaacacatcatggctaatccaaccattatcaggctacaggatggcaacgtaatgccacaacttgggctgggagtctggaaagcaagcaatgaagaggtgatcgcggcgattcataaagcgctggaggtgggctatcgatcgattgataccgccacagcatatcagaatgaagaaggcgtcggcaaagcgctaaaagcagcgagcgtagcgcgggaagagctgtttatcaccaccaagttgtggaatgacgatcaaaaacgtccccgcgaagccctgcaggagagtctgaaaaaactgcagcttgattatctcgatctctatctgatgcactggcctgtaccggctatcgatcactatgtcgacgcctggaagggcatgatcgcgctgcaaaaagaggggctggtaaagagtatcggggtctgtaactttcagatccatcacctccagcgtctgatcgatgaaaccggcgttacccctgtgatcaaccagatcgagcttcaccccttgatgcaacagcgccagctacatgcgtggaatgcgacgcataaaatccagaccgagtcctggagcccgctggcgcagggtggcgaaggcgtattcgatcagaaagtgattcgcgaactggcggataaatacggcaaaacgcccgcccagattgttattcgctggcatctggactgcgggctggtcgtcattccgaaatccgtcaccccttcccgtatcgcggaaaactttgctgtctgggatttccgtctcgataaagatgaattaggcgagatcgcaaaactggatcaaggaaaacgcctcggtcccgatccggatcagttcggcggttaagccggatttatcgcacgccatgcccgacgatgtcgtcgggcttttttgcattccgaaacattaagaaacaattacgcgcatttaacagtatatttcccccacacacaagcgcagaattattctgattttgtgaataattattcatatttattatgaatttacttaatgcatataaaatatttatggatgtgtgattgtggcggaaaaaaatctcagggcgtcaaatggctcccattcattcttattctggttatcgccgccggactgtggcagctaacgcccccttccgggttaagcgcgccggcctggcattccgcgattatttttgtcgcgacgatcgcctctatcgtggcgaaagtgctgcctattggcgcggtcggtattattggtatcaccgtctttgcgctcgcctatgctgccggcgacaaaacggccagcggcgcgattaccacggccttgagcgagctgaacagttcgctgatctggcttatcgtcgtcgcctttatgattgcccgtgggtttatcaaaaccgggctgggtcggcgtatcgccctacaaatgatccgtctgttaggtaaacgaacgctgggtctggcttatggtctggcgtttgccgatctgatcctctctcccgcgatgcccagtaacaccgcgcgctgcggcggcgtgatttacccgatcgccgactcgctggcgcgcagctttgattcacatccggaagatgagtctcgcagcaaaatcggcacctttctgatcacctgtattggcaatgttaacgacgtcactgccgcactgtttatgaccggttatacgggtaacctgctggcggtaaaactggcggcgaacgccggcgttacgttgagctggggaagctggtttatcgccgcgctcctgccttgcctggtctcttttcttatcgtcccgctgctggtctactggctgacccgtccggaaattaaacatacgccggatgcgccggatttggcgcgcaaagagctggcgcaaatgggcagtatgacgcgcggcgagtggctcatgctggcgaccgtcggcgtgttgctggtgctatggatttttggcagctcgctcggcgtggatgccacgacggcctcttttgtcggtctctctattttattactgagcggcgtgctcacctgggaagacgttaaaagcgaaaaaggcgcctgggatacgttgatttggtttgccgcgctgctgatgatggctaaccagttgaagaaactaggattcaccagctggtttggcaacctgattggcgacagcatcggcagcacgatgcatggaaccagttggataatcatcctgctgctgcttaacgcagcctatttttatacccactatttttttgccagcggcaacgcgcaaatcgccgcgctgtatgcggtatttctgggcgtcggtctgcatctgaatataccggcggcgccgatggcgctcatgctggcgtttaccagcagcctgtactgctctcttacgcagtatacccacgcacgcggccccattctttttggcgccggctatgtaccgacgggcgtctggtggcgaacgggatttattatcagtctctttaatcaggcggtctttttgacagtcggcctcgcatggtggaaagtgttagggttgtattaaacgcttaacgcatcgataagcccctcggttaacggagaaatggaatgacctgcattttctgtcaaatagttgaaggtaaagcaccttgtcataaagtttgggaagatgagcatcacctggcttttttgtcgatttttccgaataccgatgggtttaccgtagtgatcccgaaaaaacattaccccagctacgcgttcgatctaccgccgcaggcgttagcggacctgatgctggcgacccaaaaagtggcgaagaaactggataaggctttcccggatgtcagtcgtacgggaatgttcttcgaaggtttcggcgtagaccatgtgcacagtaaattaagccccatgcacggtactggcgatttaacccactggaaaccgattgaatcgcggcagaataaatttttcgaacagtatgaaggatatctgtcgtcacacgatcatgaacgggctgatgatgaaaaactggccgcgctggcggccagaattcgtgaggcataaatacggagcacttctgccggatggcggtgtaagcaccttatccggcctacaaaactgtgctattcatagacctgataagcgcagcgccgtcaggcattataccttagattatatacttcttatctattttaatatatcaaccctggtaggttaaatattacggcgcgtggctaaatatttcgtacaaaaaccatccaggaatagcggcaataacacccattaaaattatccctgcaagagtcatttgcctgtcttcacgtttttccatattacatgctttaatagccattatgaatataacaacagctattatagcaattacgataaaacagggaataataatcatacccatgatatcccctcctctggggctgtatacaagcatcatgccttaatcattaaggtaatatataattaatttatacaatcaataatatttaaataaaatataaagctccccgtaatttagcaattactaaagatcgacacaatatatttagatgtctgttacttccagaaacattagcttccagaagcaacagattcaaaggtaattaacgccctgcgcctttcccgcgcttcttattcgcagcaagcccctgccgctgatgttccaccggcgtatgcttggtcaacgccgggcgcgtgttgcggttctggcgacgcgcttcgcgcatctcttcaatggtcggcgcaggcaccagacactcacggcgaccgccaatcaaatgctttttccccatcgcttccagcgcctggcgaatcagcggccagttcgccggatcgtgataacgcagcagcgccttatgcaggcgacgctgcctgtctcccttcggcaccaccacatcttcactcttataaccaattttacccagcgggtttttgccggtgtaatacatggtggtcgaatttgccaacggcgacgggtagaagttctgcacctgatccagacggaagcggtggcgcttgagccacagcgccagattcaccatatcctcgtcccgcgtgcccggatgcgcggagataaaatatgggatcagatactgctcttttccggcctgtttagagtaaaggtcaaataactctttaaagcgatcgtagctgcccatacccggcttcatcattttcgacagcggaccttcttcagtatgctccggcgcaatcttcagatagccgcccacatgatggctcgccagctctttaatgtagcgaggatcttctacggcgatgtcgtagcgcacgccggaggcaattaagattttcttaatgcctttcagctcacgggcgcggcgataaagattgatcgtcggcgtatggtcagtatccatatgcggacagatatccggatagacgcatgacaggcgacgacaggtctgctccgcacgcggcgacttacagcgcagcatatacatgttcgcggtaggaccgcccagatcggagatcacgccggtaaaccccggcaccgtgtcgcggatcgcttcgatctcgttgatgatagagtcttctgaacggctctgaatgatgcgcccttcatgttcagtgatcgagcagaaagagcagccgccaaagcagccgcgcatgatattgatcgaaaagcggatcatctcataggccggaatacgggcattgccgtaagccgggtgcggcacacgctgatacggcagcgcaaacacgctatccatctcttcagtggagagcggtatggcgggcgggttgatccagacatagcggtcgccgtgtttttgcatcagcgcccgcgcgcagccagggttagtttcgtgatgcagaatacgcgacgcatgggcgtacagcaccttgtcgcctttcaccttttcaaaggatggcagcaggatataggttttttcccacggcttcggacgcggcggctgcacggtaatcgctttagcttcctgctttttcggcgcgaccggcttgttatccgcgcacggcagatcctcgccatagggatggggaattggatcgattttacccggcgtgtccagacgagtggagtcgacgccgctccagcctggcagcgcttctttaaccataatcgcagtgttacgcacatcacgaatctgatcgatggtttcgcccattgccagacgatgcgccacttccaccagcggacgctcgccgttgccaaacatcagcatgtcggctttggaatcgactaacactgaacgacgcacagtatcagaccagtagtcgtaatgcgcggtacggcgcagactggcctcaatgccgccaaggatcaccgggacatctttccacgcttctttgcaacgctgggtatagaccagcgtggcgcggtccgggcgtttgcccgcgacgttatccggggtgtaggcgtcatcgtggcgcagcttacggtcagcggtgtaacggttaatcatcgagtccatgttgccggcggtgacgccgaagaacaggttcggttttcccagacgcataaagtcgtctttgctgttccagtccggctgggcgatgatccccacgcggaagccctgcgcttccagcatacgaccgcaaatcgccatgccgaagctcggatggtcgacgtaggcgtcgccggttaccagaataatgtcgcagctatcccagccaagttgatccatctcgtcacgtgacatcggcaaaaacggcgccggcccaaagcaggcggcccagtactgcggccaggagaaaaggtcgcgatccggttggatcagggagatagcgctcataatgcttccaaaacgattggcaaaaaaataatcaaaggtcggggattataagccgtatctatagcgaaaatgaaggagattatcgccttatatgcaggactggcgcgaaatagaaacaactttcaacggcctggcctgaggtgtttgaaattggtcttatgaatatcttcaaattggtatgcaattaattatacccacgtctaaaaacgcagtatcgtcataacaacaaaaagtaaaaaaacatcacattatcagtaatatataaaaaaacttcgctgaattgctcacgacactgtttttaccatgactttcttctgtgaaccagatctctttctttggtctattgattaaattaaattggctgacagaattcaggggataaagaacaccatcaccacgcctttccccaacgcaacaccttacgtatcagcaggttattaattaatcaacgataaccacaggaatcccaacctataaggaagcagatatgaaaaacacacgttcattcacaacatcagcggtattactggccggctgtttgctactggcatttccagcgctcgccaaaaccacgctgaaactgagccacaatcaggataaaagccacgccgttcacaaagcgatgagctatctggccgacaaagcgaaagcctattcggacggcgaattaaatattcgtatttaccccaacgccacgctgggcaacgaacgtgaatcgctggaattgatgaactccggcgctctgcaaatggtgaaagtcaatgcggcatcgctggagtcttttgcgccggaatatagcgtgtttagcctgccgtttttattccgcgaccgcgatcactactacaacgtactgaaaagcgacttagggaaacgcattctcgcgtcctccgaaagcaaaggcttcgtcggcttaacctggtacgacggcggcgcccgcagtttttacgctggtaagcccatcactcaacccgacgatttagccggtatgaaaatcagagtgcagcaaagccccagcgctatcgcgatggtgaaagctctcggcggcgtgccgacgccgatggcgcaaggcgaactctataccgcgctccagcaaggcgtggtcgatggcggcgaaaacaaccccgtggtttatgccgatatgcgtcatgcggaggtggcgaaattctattcccgcgacgagcacacgatggtgccggatgtcctggtcatcagtaccaaagtacttaacaaattgagcgataaagagcggaaggcgttatataaagccgcagatgaatccatgcagcaaatgaaagatgtcatctggcccgccgcggaaaaagaggcttatgagagcatgaaggccatgaacgcgactgttgttgatattgataaatccgcgttcaaacagcgtgttaagcccttgtttgatgagttccgcgcaaaagacgctcagtcagcgaaggatctggaatacatcgagaatatgtaaatctgccgggcagggttctcctgccctttacaggatgtaatatgcgaatactcaccaatgcactgaacaaaatactggccgggtgctgctgtattattctggcggtcatggttgcctgcgtatcctggcaggtggcggcgcgctttatattcaacgcgccaagcagcacgctcgacgaattcacccagattctttttatgtggatgattctgttaggcggcgtctataccgccggattaaaaaaacatttagctatcgatttgttagcgcaaaaactctcccgaacgcccgccctcatgctcgacagtatcattcaggtgattattaccgtgttcgcgctgatttttatggtgtacggcggtgatattattgttgaaaaagcggcgcacgtcagccaaatgtccccggtattaaaatggcctatggataaagtctattgggtcatgccgattagcggcgtcatcctggtgtactacaccattgtgaacgttattgataattatcatcagcgccatcttcgctaacgagggatatatggactttgaatatatttacccaataattgttttatttggcagctttgccattatactggcggtcggcgttcctattacattcgctatcgggctgtcgtccttattctcaatcctgatagcccttcccccggatgcggcaatctcggttatttcgcaaaaaatgaccgtcggtctcgatggctttacgctgctggcgatccccttttttgtgttagccggcaatatcatgaataccgggggaatcgcccggcgcctggtgaatctggctcaggcgttagttggccgccttcccggttcgctggcgcactgcaatattctggcgaacaccctgtttggcgcgatatccggctcggcggtcgcttctgcggccgcggtgggcggcatcatgtcgccattacaggaaaaagagggctactctccggcgttctctacggcgatcaacgtcgcttcggcgccgattggcctgatgatcccgcccagcaatgtgctaattgtctattcgctggctagcggcggcacctctgtcgccgccctgtttttggcgggctacctgcccggcatcttaaccgcgctggctttaatgacggtagcggcgctgtatgcccatcgccaccattacccggttgccgaacgcatcaacctgcggcagtttctgtcggtattccgcgattcgttgcccagcctgttgctgatatttattattatcggcggcattatcggcggcgtatttacgccaacagaggcctctgcgatcgcggtaatctatagcctggcgctggcggccatttatcgagaaattaatgtgagtaagttgcgcgatattctgctggattcggtagtaaccagctctattgttctcttactggtcggctgctcaatgggaatgtcatgggcgatgaccaatgctgatgttcctgaactgattaatgaaatgattaccagcgtgtccgaaaataaatgggtcatcttgctgattatcaatctcattttgttattcgtcgggacgtttatggatattaccccggctattctaatctttacgcctattttccttcccattgctcaacatctgggaatcgaccctgtccattttggcattattatggttttcaatttaaccatcggactgtgtacgcccccggtaggcactattttgttcgtcggttgcagtatcggcaaaatcagtattgataaagtcgtcaaaccgctattaccgatgtttctggcactctttgtggtcatggcgatgatttgctacttcccgcagttgagtctgctgcttcccacgctgtttgctccttcctgaaaaccctgacgggtctgcgctattcagacccgtactcggacgctttacgacgctggattcaccagcatttgcccaatcgagccgcggtcagccatttccagcgtctggctgttgaaatagaacgggaagtgcggccaggacggctgaccgtaatagaccagcagttcgacttgcccatccacccagacggtatctttccagcctctatcttccgggaacggcatagcgccgttgacgttacgaatcaggaaagagacgccctcaatatggaacgactgcggcatatcggcgcgtaccgtccagcgctcccaggtgccttgttgggcggtaatatcaatgcgattcacatcccacagttggccgttaatccccggatcgtcgccaagactgatgtcccgactgcggacaggcgcgccgctcatgatctccgtcggcaacagacgcatcggcagattatcggtcaccagcggcagcaatccggttggccgtaacgtcagcaccagggtcgaaaccagaatactggaaggctcaaagaaaccgcgaatccgatcgactatgctggccgcttccccgcaggtgatcgagacttcgtcgccgttggtcatatcaaccaggatttcacgtcgctcgccgggcgccagtgacaactgtttgacggaaaccggcgcaggtaaaaagccctgatcgcctgaaatcacatgcagcgcccggccatcgctcatctgaagctgatagcgccgcgagttcgaggcgttcaacaaccgtaaccgcacccagccgcgggacacttcgacataggggctttgcgcgccgttcaccagcagcgtatcgccgacaaaaccaccgcttcccggttcgctgtactccggcgtcccaaagttatccagccgtttatcctggataatgacgggaaaatcatccacgccgtaatggttcggaatgggcagcgttttactgatgtcgtcttcgaccagccacattcctgccaggccgttatacacctgctgcgcggtgcggttaggcgtgttagcgtgataccacagcgtcgcggcgctctgacgaatcggcaacaccggcgcccagtccgcgttcggcgacatcatacgcgccgggccacccatcagcggccccggcaccagtaaaccagcaaccgtcatggagacattttccgccaggcggttgctatagatgagtttaacgtcatcgcctttccagacgcggattgtcggccccagataacgaccgttcactccccagaccggcgcgcgcgtgccttgcgtaaaggaccagtgcgctcgctgtagcgtcataaacaacggctgcccgcgacgggactccagcaacggcggaacaggcaacggctgttgctgaccggcagcattcgccctgaggggaatcgcgcctgcacatagtgcgattcccgatgcctgaagaaactgacgccgactgaatgacatataagctccatgtaaaacaggctaaagagttgtgcctgaaaaaatgatttctacaataacagagtaaggctgcttaaaccttaccggtcgcttcacgttccgcaacctctttatcaagttccgcgattttttgctccattaacgcacggcagtgggccgccagctcgcgaacctgatctttaccatattcgctgacgtcgactggcggcagcatttccacaataaccagtccgttgttcaggcggtttagattgactttgttagaggtgttggaaacgcagacaggaatgatcggcacaccagccgcgatagccgcatgaaacgcgccggttttaaacggcagcagaccgcgtccccggctacgcgtaccttcagggaacatccagatagaaatacgacgctttttaaaatggttaaccactgccgcaatggtgctatgcgctttggcgcggttattacggtcaatcaacagattaccggtcagccagtacagttgcccaaaaaacgggatccaaagcaggctttttttccccaccgtcaccgttggcggctgcacaatattcgccgccgtgaccatatcataattattctgatggttagcaatatagatagcattgccatagttttccgcgtcggcgggtttgcggcactccactttcaggccaaacagcggggccagacggccgaacatatgtccaaacgtcgccacgtgttttgggttacgtgggctgaaaaggcagtaaatagaaccgaaaacacagaccagaatggagtaaataacggtaacaataagacgaaaaatatatagcataacaacctctgaaggcctaagagcccggcattctacgtcacctgaaattcaggttaggattttggtaagtgtggctctctggaaaaacgtattgttaatcgcaatgcacgaataaacaacggttttacgggaaattttaatgttaatccgatctgaaaccgtaggccggataagacgctactgcgtcgtcatccggcaacggcagagcgccggatggcggcttagatgccttgtccggcctacgggcgcccctgtcttactcttcgctgtcgccatgacttacgcgatgcggcgaatcaatctcaatgcgatcgatacgctgcaggccgcgcattaatgtgccacggcgtccgcgttcaccgaccaccttttgtaactcttcagggcgcagtttgattttgcgcttcccgacatggatagtcagagtgctttgtggcggcagcacgtacaggtgcgccagtccatcatcgcctttcgccgcttctgcagaggggatattaatgatcttattccctttgcctttcgacagctgcggcagagagtctaccgggaacatcaacatccgtccggcctgggtaatcgccagcagcatatcgtgctcgtcttcaatcaccagcggcggcatgacgtgcgcattttccggcagtgtaatcaatgtcttaccggcacggttacgggcaaccagatcgttaaacgtacaaacgaagccgtagcccgcatccgacgccatcagcagtttctggtcatcgccttccatcagcatatgctctacggtcgcccccggcggcagcgtgagtttgccggtcagcggctcgccctgcccacgcgccgacggaagcgtaatgggatcaatagcatagctgcgcccggtggtatcaataaacaccaccggttgattgctcttacctttcaccgcggctttaaagctgtcgcccgctttatagttaagccccggcgcatcaatatcatgacctttggcgctgcgcacccagcccatctgcgacagcacgatagtcaccggttcggacggcagcatatcgtgttcgctcatcgctttagcttcttcgcgctcacgcagcggagaacggcgatcgtcgccataggcatcggcgtccgcctgtagttcttttttcagcaaggtattcattttgcgttcggacgcgagaatgccctgcaactggtccctctctttttccagctcgtcctgctcgccgcgaattttcatctcttccagtttggcgagatggcgcagtttcagttcgagaatcgcttccgcctgggtttcgctgatgccgaaacgcgacatcagcgcgggttttggctcgtcttcgctacggataatctcaatcacttcgtcgatgttgagaaacgccaccagcaaaccttcgaggatatgcaggcgcttaagcactttctccagacgatagttcagacgacggcgcaccgtgtcgcggcggaacgccagccactcggtgaggatctccagcaggtttttcaccgccggacgaccatccagaccgatcatgttcaggttaatacggtagcttttttccagatcggtggtggcgaacagatggttcatcacctgttccatatccacacggttggagcgtggcacaatcactaaacgcgtcgggttttcgtgatccgattcatcgcgcagatcgtccaccatcggcagttttttattacgcatctgcgcagcaatctgctccagcactttcgcgccagagacctgatgcggcagcgcggaaattaccacagcgccgtcttctttggtccataccgcgcgcatacgcacggagccccgcccgttttcgtaaattttacgaatttccgcacgtggggtaatgatctccgcttcggtcgggtaatccggcccctgaacgatatccagcaactgatccagcgtcgttttcggctgctcaatcagcgtaatcgccgctttcgccacttcgcgcaggttgtgcggcgggatatctgttgccatgcccaccgcaataccggtggtgccgttcagcaggatgttcggcagacgcgccggtaacattttcggttcctgcatggtgccgtcgaagtttggcacccagtccgccgtcccctgaccgagttcgcttaacagcagctcggcgtatttggacaggcgggattcggtataacgcatcgccgcgaatgacttcggatcatccggcgcgccccagttcccctggccatcgaccagcgggtaacggtaagagaacggctgcgccatcagcaccatggcttcatagcaggcgctgtcgccatgcgggtgatacttacccagtacgtcaccaacggtacgggcggattttttaaatttagcggtggcgttcagccccagctctgacatcgcatagacgatgcggcgctgtaccggcttcaggccgtcgccaataaacggcaacgcacgatccatgatcacgtacatggagtagtttaagtaggcgttttccgtaaattcatgtagcgcaaggcgctctgccatatcgctcattaacaggggatcctcaatctgcatgctgaccgttcggacggcaatattgccgcagataataccctatctcacggtctgagtcacaaaccgtgagacaggtggcgaggaagttaacgaagcggcagatagatatccgtcagcagctcatgttccgcgacctcatggacgaaattcaggtactggaagaagaccggaaaatcgcgcggcgtctcaccgctggcgggtagccattcgcggaataaataccacacgctctccgggaggctgtcgagcgatccctgatggcgcaccaccgcgcagcgcccgccaggaatctcgctattcaccacgccaacgtcattttcggctatcggctggcggacgctgccgcagatatcaaagcggaattgagccggcggcgtcgtctgcgggtcgtgccaggcaataccaaaagtttgactgctggcaatcggcgactggcccgtttcgcgtcgccatgcaataaatttcgccgcgctggcgttgaccttatccggatgccccagatgcgtcagcatcgcgacgcgggtaggtggaaattcaacgatttttacgtccatgacatgctgctcctgtaacgcaagtttaggaacgcgctggtgccaggccagccagtccggcgattgccgaaaccggcgcgggctttgaccaaacgcggttttgaaagcacgtgtgaacgactccggattctgaaacccggcatccagcgcgatatcgataactttatcctgcgggttaaacgccagccgccatgacgcgcggcgcaaacgcaaccactggatatagcgatagagcggaagcccgctccaggtggtaaactgccggtgaaaatgaaacggcgagctgtgcgccatccggcttaacgcctcaatcgacagaggctcatccagatgacgctcaatgtggtcgcaaacgcgccgcagacgttcggaataagccgcgctgatcaggtcattcatcactgcctccttgtggcctattctgcccaccgggcggctgtgaatcctgaccgatcttgcgcaatgtgggattacggattcactttacgaatctgttttacgtcgatttcgacagagttccagtctttatccacttcgccctgaatttcaacggtatcctgcggggttacggtcaggccgttccagcgcttgtggtcaatgtccacattgatagtaccggtcgcatctttaaacacatacagatcgtcggaaatgcgctcgacgatattcccgcgcagcgttacccacgcatcgtcacgcagcgatttagcgctctctaccgtcgtgctgctgccgttcgggccgacaaatccgccgccttgcgtttgcgtcgccgacgggccggagaaaccgccctgctgagccgccagaaccggggtagaacacagtgccataacggcaacgattgcagctaattttttcatgattacttttccctttcatgtcgtttcagatccatttaataaggtaatccttaacaacttcttaaggcaaaaaaagaatctttttttctgtacatcgcctgcggcgacaaggttaactgacggcaacgcgagttaccgcaaggaagaacagatgcgaattttactggtagaagatgacacacttattggcgatggcataaaagcgggcctgagtaaaatgggtttcagcgtcgactggtttaccgagggacgtccgggcaaagaggcgctttacagcgcgccttatgatgcggttattttagatttgacgctgccaggcatggacggacgggatattttgcgcgaatggcgcgaaaagggtaaacaggaaccggtactgatcctgacggcgcgcgacgcgttagcagagcgcgtcgaggggctacgtctgggcgccgatgactatttatgtaaacctttcgcgctcattgaggtcgccgcccgtctggaggcgctggtacgccgcgccagcggtcaggccagtagcgaattgcgccacggccaggtgacgctcaatccaggcaatctcgtcgcgacgcttgccggcgaaccactggccctaaaaccaaaagagttcgcgttgctggaactcttactgcgcaacaaaggtcgcgtgctgccgcgcaagcttattgaagagaagctgtataactgggatgacgacgtgtccagcaatgcagtggaagtccatgttcatcatttacgccgcaagctcggcagcgaatttattcgcaccgtgcacggcatcggctacaccctgggtgacgcatgaaattgacgcaacgtctcagcctgcgcgtcaggctgacgcttattttcctgattctggtctccatcacctgggcaatctccagttttgtggcctggagaaagacgacggataatgtcgacgagctgtttgacacacagttgatgttgttcgccagacggcttagcaccctcgatcttaacgagatcaacgccccgcagcgcatggcgcatacgccaaagaaattaaaacatgggcatatcgatgacgatgcgctggcgttcgccatcttttccgctgacggcaaaatgttgctgcatgatggcgacaacggccaggatattccgtatcgctatcgccgggaaggtttcgacaatggctatctgaaggatgacaacgacctctggcgttttttgtggttgaactcggcggacggcaagtatcgtatcgtcgtcggtcaggagtgggattaccgcgaagatatggcgctggcgatcgtggcggcgcaattaacgccgtggctgatcgcccttcccttcatgctgctaattttattactcctgcttcaccgcgagctcagaccattgaaaaaactggcgcaggcgctacgcttccggtcgccggaatcggaaacgccgctcgacgccaaaggcgtaccgagcgaggttcgcccactggtcgaagcgcttaatcagctttttagccgcatccactccatgatggtgcgcgaacggcgatttacctccgacgccgcccatgaattgcgcagcccgctggccgcgctgaaagtacaaaccgaggtggcgcagctctcgggcgacgatccgctatcgcgtgataaagcgctgacccagctccatgcggggatcgatcgcgccacgcgactggtcgatcagctactgacgttatcgcgtctcgactcgctcaataatttgcaggatgtagcggagatttcgctggaagagctgctgcagtccgcggtaatggatatttatcatccggcgcagcaggcgaatatcgacgtgcgtttacagcttaacgcccatgacgtcatacgtaccggccagccgctactcttaagcctgttagtgcgtaacctgctggataatgcgattcgctacagtccgcagggcagcgtcgtcgacgttaccttacatgcccgcagcttcaccgtcagagataatggccccggcgtagcgccagagattctgacgcatatcggcgagcgtttttaccgcccgccaggccaaagtgtgaccggcagcggtctgggattatcaatcgtccgccgcatcgctacgctgcacggcatgacggtgtcgtttggcaacgccgcggaaggtggatttgaggccgtagtaagttggtaacagagacttttgccaaaaacgcaaaagactttgcacattttgctaatttcaccgcaccgcccgtcagcgtagaatcagcagcaaacgcatttcttgaggacacaaaatgagtaacatcctgattatcaacggggcgaaaaaattcgcgcactccaacggccagttgaatgacaccctgaccgaagttgccgatgggctgctgcgcgatctgggtcatcaggttaagatcgtccgcgccgacagcgactatgacattaaagaagaggtgcagaatttcgtctgggctgacgtggtgatttggcagatgccaggctggtggatgggcgcgccatggacagtaaaaaaatatatggatgatgtctttaccgaaggtcacggtacgctctatgccagcgatggccgcacgcgttccgatgccgctaaaaagtacggttccggcggtctggtgcaggggaaaaaatatatgctgtcactgacgtggaacgcgccgatggaagcatttaccgaaaaagatcagtttttccacggtgtaggcgtagatggcgtctatctgccattccataaagccaaccagttcctgggcatggacgcgctgccaacgtttattgccaacgacgtgattaaaatgccggatgttccgcgctataccgcagaatatcgcaagcatctgagcgaaatttttgcttaactggtcatcctggaattagaaggagttaaccatgcttaccgtcattgccgaaattcgcacgcgtccgggccaacatcaccgtcaggccgtcctcgaccagtttgcgaaaattattccaaccgttcttaaagaagaggggtgccacggttacgcgccgatggtggatcatgccgcgggcgtgagttttcagactctggcgcctgactcgatcgtgatgattgaacagtgggaaagcgttgcgcaccttgaggcacatctgcaaaccccgcatatgaaagcctacagcgacgcggtaaaagacgatgtgctggaaatgaatattcgtattctggaatccggcgtttaagttattaccctcgtctgacgtcgccctgatgcgatgcgcaagtgtcgccatcaggctgcggcgtcatgtcggattcgcttatccggcctgcggcatgcagaccagataaagcgtgcaacaaccgttacacgtcgagatccgcgagatcgcctttttcctgtagccagttgcgtcgatcttcagaacgtttcttcgccagcagcatatccatcatcgcattagtacgctgatcgtcttcatcgctaatggtgagctgcaccaggcggcgagtattcggatcaagcgtggtttcgcgtaactgcatcgggttcatttctcccaggcctttgaaacgctgtacgttcggcttgcctttcttacgcttcagttgttccagtacgcccgccttctcttcttccgtcagcgcgtaatagacctctttacccaaatcgatacggtatagcggcggtagcgcgacgtagacatgaccattcttcaccagcgcgcggaagtgtctgacaaacagcgcgcaaagcagagtagcgatatgcaaaccatcggagtccgcatccgccaggatacagatcttgccgtagcgcagctgactcagatcgtcgctgtccggatcgataccgatcgccacggaaatatcatgcacttcttgcgaggccagcacttcatcggaagagacctcccaggtgttaaggatcttacctttgagcggcatgatcgcctgatattcgcgatcgcgcgcctgcttggcggaaccgcccgccgaatccccttccacaaggaacagctcggtccgattaagatcctgcgcggtacagtccgccagtttccccggcaacgccgggccgctggtgagctttttgcgcaccactttttttgcggcgcgcagtcgccgctgcgcgctggcaatcgccatctctgccagttgttccgccgcctgcacgttctggttcagccacaggctgaaggcatctttcaccacgccggaaacaaatgccgcacattgacgcgacgacagacgctctttggtctgcccggcaaattgcgggtcctgcattttcacggaaagcacataagcgcagcgatcccagatatcttccgccgacagtttgacgccgcgcggcagaatattgcggtattcgcaaaattcgcgcatcgcgtcgagcaggccctggcgcagaccgttgacgtgcgtccccccctgcatggtcgggatcaggttgacgtagctttccgtcagtaattcgccgccttccggcagccacaatagcgcccagtcaaccgcttccgtttcaccgttaaaattaccgataaacggcttttccggcagcgtcggcaggccgtttaccgcttcgcccagatagtcgttcagaccatcctggtagcaccagcgctgctcgctgttattcacttcatctttaaaagtgatttccacgccgggacacagcaccgcttttgctttcagaacgtgcattaagcgagagacagaaaaacgcgggctgtcgaagaaactttcgtccggccagaaatggacgctggttccagtattacgtttaccgcaggtgccgacaacctgcaaatcctgcactttttcgccgttttcaaacgcgatgttatagacctgaccgtcgcggcgcacggtcacttccacgcgctttgacagggcatttactaccgaaatccccaccccatgcagaccaccagagaactgatagttcttattggagaatttaccgccggcatgaagccgacagaggatcagttctaccgccggaaccccctcttccggatggatatccaccggcatcccgcgtccgtcgtcaatcacttccagcgattgatcggcatgtaaaatgacatccacgcgtttggcgtgacctgccagtgcttcatccacactattatcaatcacttcctgacccaaatggttggggcgggtcgtatcggtgtacatccccgggcggcggcgtaccggctcaagcccagtgagtacctcaatggcatcagcgttataagtttgcgtcatggtttaattagcaattcgaattgattgtcagcaactgtgcagtccaagaaaatcgacaatctggttgaaataatcttcgaagcccgtgaatgcgtgattaccaccctcggtcactgtctgacggcaggaggcgtaatatgccaccgcctggcggtaatacagcacttcatcgcccgtctgttgcagtagccagatcaggtccggcgcttccagcgggtcaatctgcatgactttaagatcataaatatggcgagactctagcacatattgctgcccggtgtaggggttctcgttctgaccgagatagtcggtcagtaattcaaagggccgcacggcgggattcaccaccacagccggcagcataaaacattgcgacagccaggtggcgtaataaccacccagcgacgatcctaccagccctaatggcgcaccgccatgctcaagcacgagagattccagcaactccgccgcatcggcaggatacggcggcagctgagggacgatcatctcaacatgcggatgacgctccgccagccagttttttagctggcacgcttttgccgagcgaggggaactgttgaatccgtgcaaatagagaagcgtagacatcagtatccttccgaagcggtatcgggtcggaaccgggtatcctgcaggcgatgcacttccgtctccaggacgccgttcgcccggagctccagcgtacgccagcccggcgcgatagtatccagcgtaaagttcgcgcagtgcggtttgaactgtacgcaggttgacggcgtacgccagcagacggcgaccgttccagtcaagatccagctcctggtgaatatgtccgcataacagatattttacacgcgggaaattcgccagcacgctatccagctcaccggcattacgcaagctgtgctgatccaaccaactgcaccctgccggcaacggatggtggtgcaacaggagcaatgtctgtctctctggcgcatcggcgagcttacgctcaagccattccagttggaactcgctcagttcgccatgcggaacgccaaacacctggctatccagcaacaaaatctgccattgttcaccgattaacacgcgtttagccggggaaatccccgcctcttgcagcgcgctgtacattgccggctgaaaatcatgattgcccggtagccaaacgcaaggcgcgcgaaagcttgcgataccctcagcaaaatgctgataagccgcagcggattgatcctgcgccagatcgccggtggccacgatcagatcatattcatactgttgcgcccgaatagcctccagcacggcctggtaactttcccaggtattgacgcctaacagcgtttcatgcttttcggcaaacaggtgagtatctgtaatttgtaaaatcctgactcgggcctcaccagccagaggtagggttaacaggctttccaaatggtgtccttaggtttcacgacgctaataaaccggaatcgccatcgctccatgtgctaaacagaatcgtagccagtcggccagaaactgattaatttgatgcttttcgtcgcgttgatgcaactttttatttggataatcataccgcgctttgaagcgaaagatctgctggcttgaacacacttcagccaccatcgcatcatggtagaggcgcaccgtcagcgacggcaggctccagtaggtgatggctggcgtcgtttgctcgatcgttacaagcgtagtgtatcgggtcgattccacaatcgttaaccgatattgtacgttgcccacctgatagctcaccgtttcaccgggggcgtcattgcgcggcagcaggcggcgcaattgcgaaaaattggtttcgcacaaacgcatcatttctgggaagtcaggtgtataacgcttcattttttccactcgttttttaactcttgatgatgcaactgaagccattgcaaagcgatgactgcggctgcgttgtcgattttcccctcttctacccactggtatgcctgttcccggcttaccacatgaacccgaatatcttcgttttcatccgccagaccatgaatacctaccgcggtcgtggcgtccacttcacccaccagaatagatgagcgctcgctggttcctcctggactcgccaggtaactgatgaccggtcgggtgcggcccacggtcagccctgcttcttccatcgcctcccgccgggcgaccgcctcaatggtttcgccttcttctatcatgccggcgaccatctccagcagccacggcgtaacgcttgtgtcatatgcggcaatacgaatctgttcgaccagcaccacctcgtcgcgttcagggtcaaagggtagcaagacggcggcgtgcccgcgctcaaaaatttcgcgctttacctcgccactcatttctccgttgaataaacgatggcggaatcgatacacatccaatgaaaaaaaaccgcgatagcgcgtttcccgtgcaataatttctacatcgcttttggtgaaagtaactggcaagttgtctgatttacgcattgtgctgccctgctagcaataatgattaaatgatgaatttcaagggtggttgactgctgttttatcacccttgtggtaaattggtgccaattaaggctcgtatggcacgtaacgccaactttttgcagtggcggattctgctagaatcagcaattatttttacaaattgatcagcgctaaatactgcttcacaacaaggaatgcaaatgaagaaattgctccccatccttatcggcctgagcctgtcggggttcagcacactaagccaggcagagaacctgatgcaagtttatcagcaagcacgcctgagcaacccggaattgcgtaaatccgctgccgatcgcgatgctgcattcgaaaaaattaacgaagcgcgtagtcctttactgccgcaactgggtttaggtgccgactacacctacagcaacggttatcgcgatgcgaacggtatcaactccaatgaaaccagcgcttctctgcaattaacgcagacgctatttgatatgtcgaaatggcgtgggctcaccctgcaagaaaaagcagcaggcattcaggatgtcacctatcagaccgatcagcagacgctgatcctcaataccgcgaacgcgtattttaaggtattgaacgctattgatgtgctttcctatacccaggcgcaaaaagaggctatctaccgtcagttagatcaaacgacgcaacgttttaacgtgggtctggtcgccattaccgacgtgcaaaacgcccgtgcgcaatatgataccgtactggcgaatgaagtgaccgcccgcaacaacctggataacgcggtagaagagctgcgccaggtaaccggcaattattacccggagctggcgtcgcttaacgtcgagcattttaaaaccgacaaacccaaagctgttaatgcgctgttgaaggaagcggaaaaccgtaacctgtcgctgttgcaggcgcgtttaagtcaggatctggcgcgcgagcaaatccgtcaggcgcaggatggtcacctgccgacgctgaatttaacggcctcaaccggcatttctgatacctcttatagcggttctaaaaccaactccacccagtacgacgatagcaacatggggcagaataaaatcggccttaacttctccctgccgctgtatcaaggtgggatggttaactcgcaggtaaaacaggcgcagtataacttcgtcggcgcaagcgaacagctggaaagcgcgcaccgtagcgtggtgcagaccgtacgttcttcctttaacaatattaacgcctccatcagcagcatcaacgcgtataaacaggcggtcgtttccgcgcaaagttctttggatgccatggaagccggttactcggtcggtacacgtaccattgttgacgtactggatgccaccaccactctgtatgatgccaagcagcaactggccaacgcgcgttatacctatttgattaatcagttaaatatcaaatatgcgctcggtacgctgaacgagcaggatctgctcgcgcttaacagtacgttgggtaaacctatcccgacgtcgccggaaagcgtagcgccggaaacgccagatcaggatgctgccgcagacggttataatgctcatagcgccgcgccagcagtacagccgaccgccgctcgcgccaacagcaataacggcaatccattccggcattgataagttattcgctggcgctgcgcttatcagacctgtgcccttgtaggtctggtaagcgcggcgctacctgtcataaagccgcgcctgaacgtaagacaacgtaaagatcctgctattccgccgcattctcgccttttctcgcttcaatttcgaccagtcatcctctattctgaaggcatgttgtatttaccactgggtcctggaagacaaatatgaaacggacaaaatccatccatcacgcatcatttcgcaaaagctggagcgcgcggcatttaacgccggtcgccctggcggttacggctgtttttatgctggctggctgtgaaaaaagcgatgaaaccgtatcgctgtatcaaaacgctgatgactgttcagcggcgaatccgggcaaaagcgcggagtgtacaaccgcgtataacaatgcgctgaaagaggccgaacgtactgcgcctaagtacgctacacgcgaagattgcgtcgctgagtttggcgaaggtcagtgccagcaagcgcctgcacaggctggcatggcgccggaaaatcaggcgcaggcccaacaatccagcggcagtttctggatgccgcttatggcaggttacatgatggggcgtctgatgggcggcggcgcaggctttgcgcaacagccgctgtttagctcgaaaaacccggccagccctgcatacggcaaatataccgatgcggcaggtaaaaactacggcgcggcgcaaccgggccggacaatgaccgtaccgaaaaccgcgatggcgccgaaacctgccaccacaacaaccgttacccgcggcggttttggcgaatccgtcgccaaacagagcaccatgcagcgtagcgctgccggtacttcaacacgttcgatgggcggctgatacgcatggaaagagtcagtattaccgagcgcccggactggcgcgataaagcgactgaatacgggtttaattttcacactatgtatggtgaaccgtactggtgtgaagacgcttattacaagttaacgctcgcccaggtggaaaaactggaagacgttaccgccgagttgcaccagatgtgcctcaaggtagtagaacgcgtcatcgccagcgatgagctgatgacgaagtttcgtattccaaaacatacctggggttttgttcgtcagtcctggcaaacgcaacaaccgtcgctctattcccgcctcgatctggcctgggacggcatcggcgagcctaagctgctcgaaaataatgccgacacgccaacgtcgctgtatgaagcggcgtttttccagtggatttggctggaagatcagatcaacgcgggcaatctgccggaaggcagcgatcagtttaatagcctgcaggaaaagctgattgaacgctttgctgaacttcgcgaacagtacggttttcagttgctgcatctcacctgctgtcgcgatacggttgaggatcgcggcaccattcagtatttacaggactgcgcggccgaagcggaaatcgccaccgaatttctctatatcgacgatattggtctgggggaaaaaggccaatttacggatctgcaggatcaggtcattgcgaacctgttcaagctctatccgtgggaatttatgctgcgcgagatgttttccaccaagctggaagatgccggcgtgcgctggctggaaccggcctggaaaagcattatctccaataaagcgttgttgccgctgttgtgggagatgttccctgaccatccgaatctgttgcctgcgtatttcgccgaagacgaacatccgccaatggataaatatgtcgtgaaaccgatcttctcccgcgaaggggcgaacgtatcgattattgagaacggtaaaacgatcgaatccgtggaaggcccgtatggcgaagagggtatgatcgtgcaacagttctatccgctgccaaaattcggcgacagttacaccctgattggtagctggctgattaacgatcagcccgccggaattggtatccgtgaagatcgggcgctgatcacccaggatctctcccgcttctatccgcatatttttgtcgaaggatagattctcctgtaagcccgatgcgcgtagcgccatcgggcaatcattcagcgccttatccggcctaccccacctgcaccgacaacatacttatactgcccatctcaataccgtcgaccgggatggtgataggttccttgccgtcccaggcgccaagtacatacagcaaaggcaaaaagtgctccggcgtcgggttcgataaggcgcccccttcatgttgcagataattcaccagcgggtgctgttctaccggcccctgccacgtcagattggctttcacaaagtcattaaatgacgccgcccagggatacggtatattgtcaccgtgccaacgcacagtccgcagattatgaactacattcccgctggccaccagcatcacgccttcgtcacgcagcgtcgccagcttacgacccacctcaaaatgccatgccgccggtttggtactatcaacactaagctgcaccatcgggatatccgcattcgggtacatcttgatcaatacgccccaggagccgtgatcaaatccccacgcttctttatcgagcgcgacgggaacgggagccaacagttcaaccagacgctgcgccagcgcaggcgatccaggggccggataatgcgtgtcatacagcgcctgcggaaaaccgccaaaatcatggagagtttgcggcctttccatcgctgtgacgccagtcccacgggtataccagtgcgccgacaccaccactatcgcctgtggtcgcggtagggcttcccccaatcgccgccaggcgcgggtataatcgttatcgtccagcacgttcatcgggctgccatgccccaaaaacaatgctggcatacacgttaaagacatgatgttatccttactggaaagacattttgttaacatcaccatacgctttcttcacagaggaagaactcagataaccatgatgaagatcatcagttattttgaaggtcaggttcggacggcaaattgataaggagtaatggatgtcagtaccacttattctgaccttactggcgggcgccgccacctttattggcgcgtttcttggcgttctcggccaaaaaccgtctaaccgcgtgctggctttttcgctgggcttcgccgcagggatcatgctgcttatctcgctgatggagatgctgcccgccgcgcttgataccgaggggatgtcgcctgtactgggctacggaatgtttattatcggcctgttgggctacttcgggctggaccgcctgcttcctcacgctcatccgcaggatctggtgcaaaaaaggcagcagccgcttcccggctcgataaaacgcactgcgattttattgacgctcggcattagcctgcacaactttccggaagggatcgccacctttgtcactgccagcagcaatcttgaactgggtttcggcatcgcactggcggtggcgttgcacaatattcctgaaggtctggcggttgccggcccggtttatgccgcgacgggctcaaaacgtaccgcgattttttgggccggtatctccggcatggcggaaattcttggcggcgtgctggcgtggctgattttgggcagcctggtttcaccgatcgttatggcggctatcatggcggcagtcgccggcattatggtggcgctctccgtcgatgaactgatgccgctggcaaaagagatcgatcctaacaataaccccagctatggcgtgctttgcggtatgtccatcatggggctcagtctcgtcattttgcagacgataggtatcggttaagagaaacgtcgcgccggatgcaggcctttagccaggcaacatccggctgcccgtcaaggatatgcgctatttctgctcattcatcacgctgtcgccttcgctcgtctggcgaaaacgtttcgttcgcgcttcaagtaatgcatctctgtcttgccgaaacgctctgcaataacgcttcatatggcaaatataccctactaccaccagaacgattaatattatccaataccaggcaataaacatcctttttacccttaaaatttaacatcactaaacatttaacgttaaaattttacatacccttattttgacgtattcatatactggcatatttgtggaacaaataaatgattttgatcatataaatcagtggtgaaacacaataatgaaagaggtattaagcagaaaacaatgtcgataagatcacacttcgtactaatttatattgttcttaaaatatcacactcctactatcgactcactcaggcaattaaaaaatattgatacagaatatactttaaaataagtaacagcatcatgacttatatttaaagaccaatcatttacctcatttattattcataaaaacatagtatattcagaagtattatatttagaagttgtatataaggagatatatccatgtttgaccaataccggaaaacaatacttgccggtgccgtcgcactgacatgcggactcaccgcagccagtacgtttgccgcaggttttcaaccggcacagcccgcaggaaaattaggcgcagtcgttgtcgatccttacggaaatgcccctctcaccgcgctggtggaattagatagccatattatttcagacgttaaagttactgtacatggcaaaggggaaaaaggcgttcctgttacttataccgttgggaaagagtctttagaaacctatgacggtattcctatttttggcctttatcagaaatttgccaacaacgtcacggtagaatataaagaaaacggcaaagccatgaaggatgactatgtggtgcagacgtccgccatcgtcaaccattatatggataaccgttctatttcagatctccagcaaacgaaagttattaaagttgcgccaggatttgaagatcgcctttatctggtaaatacccatacctttacgccgcagggcgctgaatttcactggcacggcgaaaaagataaaaatgcgggcattcttgatgccggcccggcgggcggggctttgcctttcgatatcgccccttatacgtttgtggtcgacacccagggtgaatatcgctggtggctggatcaagataccttctacgacggccacgatatgaatatcaacaaacgcggctacctgatgggtattcgtgaaacgcctcgcggcacctttaccgcggtgcagggccaacactggtacgagtttgacatgatggggcaaattcttgccgatcataaactgccgcgcgggttcctggatgcgtctcatgaatccatcgaaaccgtgaacggcaccgtactgctgcgcgtcggcaaacgagttaccgcaaagaagacggcatacatgttcatactattcgtgaccaaatcattgaggtcgataagtctggccgcgtagtagacgtttgggatttaaccaaaatcctcgaccctatgcgtgatgcgctgctcggcgcgctggatgcgggcgcagtatgcgtgaacgtcgatctggcccatgccggacagcaggcgaaacttgaaccggatacgccgtatggcgatgcgcttggcgttggtgccggtcgtaactgggcgcacgtcaactctatcgcttatgacgcgaaagacgactccatcatcctttcttcccgccatcagggtattgtaaaaattggtcgcgataagcaggtgaaatggatactggcaccgtctaaaggctggaataagcagctagccagtaaattgctgaaaccggtagacgatcatggtaagccgttgacctgtgacgaaaacggcaagtgtaaggacaccgatttcgatttcacctatacccaacatacggcatggctttccagcaaaggcacgttaacggtctttgataacggcgatggtcgcggcctggagcaaccggctctaccgaccatgaaatattcccgttttgtcgaatataagatcgatgagaagaaaggcaccgtacaacaagtttgggaatacggtaaagaacgtggatatgatttctatagtcctattacctcggttgttgaatatcaaaaagaccgcgacaccatgttcggctttggcggttctattaacctgttcgacgttggtaaacccacagtcggcaaactgaatgagattgactataaaacgaaagaagtgaaagttgaaattgatgtgctgtcggataaacccaaccagactcactatcgtgcattactggttcatccaacgcaaatgtttaaataaataacgggaaggaattaatatgtcatctaaatggattacctctttatttaaaagcgtagtattaaccgcagcattggtcactccttttgcggcatcggcttttaccgagggcacagattatatggttctggagaaaccgattcctaatgcggataaaacgctgattaaggtatttagctacgcctgccctttctgctacaaatatgacaaagccgtaacaggtccggtttctgataaagtagccgatctcgttacgttcactccgttccacctggaaacaaaaggcgaatatggcaaacaggccagcgaagtatttgcagtcctgatcgccaaagataaagctgccgggatttcgttatttgatgctaaatcacaattcaaaaaagcgaagttcgcctggtatgcggcttaccatgataagaaagagcgctggtcagatgggaaagatccggcggcatttattaaaaccgggctggacgccgcaggcatgagccaggctgattttgaagcggcgctgaaagatcctgccgttcaggagacgctggaaaaatggaaagccgcctatgacgttgccaaaattcagggtgttccggcttacgtcgtcaacggcaagtaccttatctataccaaaaacatcaaatccatcgattctatggctgaactcgttcgggaactggccactaaaaaataagcagggaaacgattatggattttattaagggattatggcgagacctacgcgcaagaccagtggatacgctggtgagatggcaggaacagcgctttctgtggctgttaatggccatcgcgatgggaggattaattatcctggcgcactcgttcttccaaatctacctctacatggcaccgtgcgagcagtgtgtttacatccgttacgcgatgtttgtgatggtaattggcggggtgattgcggcgataaatcccaaaaatatcgtgctgaagctgattggctgcatcgcggcgttttatggcagcattatgggcattaagttttctattaagcttaatggtatccatcatgcggtacataatgcggaccccgattcactttttggcgtgcaaggatgttcgactgacccgacctttcctttcaacttaccgttggcggaatgggcaccggagtggtttaaacctaccggagactgcggttatgacgcgcctatcgtccctgatggcgtaacgctcagtagcgtacagcagtggtttgtcgatctctaccagcagtccgaaggctggtatctgcttccgccctggcactttatgaacatggcgcaggcatgtatgttggcctttgggttgtgcctgattctgctgctggtgatgagcggcgcctgggcattgaaactggccagaggcaaataacctgaatagataaaccaaagcagaggtctgcattcaggcctctgcttttctcacaataattttaccattcagcttattcgtcgttctttgaaactgaacgatatggcaccgaaggaatacaaaaaagccgatgacatctcatcggcttttttcaaccatgatccgttcgatcagctggctttgcgctcatgcgcctggcggtaagccaccagatcttcaatcgtgactaccgccatattatgctggcctgcaaacgcgatacactccggcgcgcgcgccatcgtcccatcgtcgttagtcaactcgcacagtacacctgcaggtttaaaaccggccagcgtcatcagatcgatggtcgcctccgtatgaccgccgcgcgtcagcacgccgcccgcctgagcgcgcagtgggaaaacgtgccccggacggttaagatcggacggttttgcgccatccttaattgccgcacgcaccgtagtgacacggtcagcggcggaaacgccggtggtcacgccttctgcggcttcaatggtcacggtaaaaccggtgccgtaggcgctggtgttgttttccaccatcattggcaagtcgagctgcttacgacggtcttcagtaatacacaggcaaacaataccgctaccgtgacgaatggttaacgccatctgttctacggtcatcgtctctgcggggaaaatcatatcgccttcgttttcacgatcttcatcatcaagcaccatcacaccgcgtccttcacgcagcgcatccagtgcaagttcaacacgttcaaaaggcgtaccaaaagaggaaagtagcgtctgattcatggtaaaaaaacctcattaatattatggttaccagaatcagggcagtcttaggagtgccgacaagcggcaaaaaaataacgtgagcgggtccatgcccgactggatcgttaccctctcccatccggactttaaccgtcggccccggaattacaccggatctgctgaccttttcgctatggcaaaaagcgctcgcgggctttcaacctgctctccgcgttccgtcacggcgcgccgtgatgagaaatgcgttaaacatcgctgatttaccgccggtggggaatttcgccccgccctgagaataagcgggttaactataacgctattgattaccttcatcaacgcctttactccgtatgacgtcacacaattctggtttatggcgtccacatatcgcactacaataagagctaacacttaccagttcagggaaaccacaatgattgacccgaaaaaaattgagcaaatcgcacgccaggttcatgagtcaatgccgaaaggtattcgcgagttcggggaagatatcgagaaaaaaatccgtcaaacgctgcaatctcagctgacgcgtctcgatctggtgagccgcgaagagtttgatgtccagactcaggtcttgctgcgcacccgggaaaaactggcgctgctggagcaacgcctcagcgaactggaagctcgcgacaagcctgaagaagtaaaacctgcgcccgccattccgccagtcgatccacaacaagagtaaaaacgtgaacgggcctgacggcccgctcatataagatctgaataatgccctgcacctgtaaagggagcctgcattagtgttctaattctaaccttttcgcctgagtcgcctgctggcagtaaagcgcgtaacgcttgcaaaaccagtcgcgatgctcctcgtccatattgccggttaccgcctggatatcaacaggacgcccctccgcctgcattctggcaaaactgcgcgccagaaaatcgaaattatttaatgaatagacgttattgttgttcatcagcataccctccagttattgaattctgttaaggctatatgctttttctgatttcagtatttccctatatgtacggcggttttatacataacgtgcgcaaatttaatgcgcaaaatcacaatattcaccaaagataacgacggataaatcgcttttcggacttaaggagatatgggtcacatgatattgtaacgcaatgaaataacaagcatgaaaattatcacgcgaacatccttctgaaggcggcgacaaggatagaaaatatgaccttatttgcggagtataacagcccctatctgtttgccatcgcgttcgttttctttatcggcgtgctggagatgatttcgctgatttttggccactttctttcaggcgcgctcgacgcccatctcgatcattatgacgccctgtcatccggccctgcgggccaggcgcttcattatctgaatattggacgcgttcccgccctggtcgtcctctgtctattggccggttatttcggcctcttcggtatcctcatccagcatggcgggatcatgctctggcaagcgccgctcagcaatctgctgctggtcccgttgagcattgtcctgtcggtctttgccgtgcattacagcggaaaaatcctcgcgccctggctacccagagatgaaagctccgccctccgggaagaggaatttatcggcggcatggcgattattaccggccacgccgccgtcgccggtacaccttgcgaaggaaaatttaccgataagttcggccagattcactatttactgctggaacccgaaaagggaaaagaatttaaaaaaggagacaaggtgctgattgtctgccgactttccgcaacgcgttatttggctgagcgtaccttctatgtttaattgagaggaacttacataatggatgatgtttttggcatattgccatcatggatgtttaccgccatcgttgcggttatcgtcttactaattatcgggatcatttttgctcgcctctatcgccgcgcatctgcggaacaggcatttgtccgtaccgggcttggcgggcaaaaagtggtgatgagcggcggcgctattgtgatgccaatctttcacgaaattattccgatcaatatgaataccctaaaacttgaagtcagccgtgctaccgtcgacagcctgatcaccaaagatcgtatgcgcgttgacgtggtcgtcgctttcttcgtacgtgtaaaaccctctgttgaaggtattgccaccgccgcacaaacgcttggccagcgaacgctgtcgccggaagatctgcgtatgctggttgaggataaattcgttgacgccttacgcgctaccgcggcccagatgacgatgcatgagctacaggatacgcgtgaaaacttcgttcagggcgtacaaaacaccgttgcggaagatttgtcgaaaaacggcctggagctggaaagtgtctcattaaccaactttaaccaaacgtccaaagagcatttcaatccaaacaatgcctttgatgccgaaggtctgacgaaactgacgcaggaaaccgaacgccgccgtcgtgaacgtaatgaagtggaacaggatgtggaagtggcggtgcgcgaaaagaaccgcgacgcgcttgagcgcaagctggaaatcgagcaacaagaagcctttatgactctggagcaggagcaacaggttaaaacccgcaccgccgaacaaaacgctaaaattgccgcttttgaggccgagcgccatcgtgaagcagaacagacgcgcattcttgctgagcggcagatccaggagacggagatcgaacgtgagcaagcagtacggtccaggaaagttgaggccgagcgtgaagtacgtattaaagagatcgaacagcaacaggtgacagaaatcgccaaccagacgaaatctatcgccattgccgccaaatccgagcagcaatcgcaagcggaagcgcgcgccaacgacgcgctggccgatgcggttcgcgcccagcaaaacgtagaaaccacccgccagaccgccgaagcggatcgcgccaagcaggtcgctctgatcgccgcggcgcaggatgcggaaaccaaagcggtcgaactgaccgttcgggcaaaagcagagaaagaagcggcagaattgcaagccgccgctatcatcgaactggcggaagcaacgcgtaaaaaaggtctggcggaagccgaagcgcaacgggcgctgaatgacgctatcaacgtactatctgacgaacaaaccagcctcaaatttaaactagcgctcttacaatcgttgcctgctgttattgagaagtctgttgaaccgatgaaatccatcgacggcattaagattattcaggtcgatggcctcaatcgcggcgcgacggcgggcgacgtcgccgctggcggcgctaacgggggaaacctggcggaacaagcgttatctgccgcgctcacctatcgtacccaggcaccgctgatcgattcgctgttaaacgagattggcatcgctggcggctcgctaaaggcgctgaccacgccgttggtttcatcggcaacggatgagattaatcgcgaagcaacgataaaagagcaataaccccccgccatatctcctgtccctggtcataagaccggggatttttttatcttttttccaccttgtctgtacaaagcgttatgaccagcaggccattttgcgtgggcgatccagtaacgcaaaatcggcgggagaaagcccttgcgccagacaggccactcaccaacaatcgcgatgtcagcaaggggctgaaacgggaaagcccctcccgaggaaggggctttaataaggaaagggttatgatgcaccaggtcatcatactgattgttctgttactgataagtttcgcagcttactaacagacaatcagagggggggagagatcccctctcacccttattcctttactttaggtcgaaaaaaaagcagcgtcaaccgcgagatacgcgtcgaaacaaaatgtccgacgcgccttcaaaatcagcgcccgccgcgtctgtaacgcctgatgacgcggttttacttctcgctctcggtctggatctttttgatgatattggtcgtggaacaaccatcttcgaagttcagcaccatgacttcaccgccgttggcccagacctcttcgctgcccgcgatctcttccggcttatagtcgccgccttttaccagcagatccggcagaataccggcaatcagtcgttgcggcgtatcctcttcaaaagagacaacccagtcgaccgactccagcgcgcctagcacgatcatacgctgttcgagcggattaaccggacggctttcgcccttcaggcgtttagtcgaggcgtcactattgaccgcaacaatcaggcggtcgcccagtttgcgcgcgttcgccagataagagacatggcccgcgtgcagaatatcgaaaacgccgttggtcatgaccactttctcgccacgcttacgcgcgctggcgacggcctgtctcaactcctcttcggtcataacgccgaagccggtatccgcgcgtccgcgcactgcgttttccagctcaataggggaaaccgttgacgtcccgagtttacctaccactacgcccgccgccgcattggcgaaataacacgcctcttccagggtatttcccgccgccagcgtcgccgccagcacgccgatcaccgtatcgcccgcaccggtaacatcataaacttcctgcgcctgcgtcggcatatgtagcggcgctttattcggttgcagcagcgtcattccctgttcggaacgcgtgaccaacagcgcggaaaggtcgtaatcagcaatgagtttcatgccgcgttcaaccagttcgtcttcgcttttacatttccccgcgaccgcctcaaattcagaaaggtttggcgtcagcagcgtggcgccgcggtaacgttcaaaatccgttcctttcggatcgatgagcaccggcacgcccgcctggcgcgccagggaaatcatagtctgcacgctggtcagagcgcctttggcataatcggacaataccagcgcgccgatcgatcccagcgcctggttgatacgctcatgcaacggctgcgggtccacgccctcaaagccttcttcaaaatcaagacgaatgagctgctgattacgtgatagtacgcgcagtttggtaatcgtcggatgcgtcggcacagaaacgaagtcgcacttcacattgacctccgccagcgttttgctcagcgcgcgcgcggcgtcatcaatacccgtcaggccgaccagacgggcgttcgctcccagagacgcaatgttcatcgccacgttcgccgcgccgcccgggcgttcctcaacggtatttaccttaaccacgggcaccggcgcttccggtgaaatacggcaagtggggccataccaatagcgatccagcattacatcacccacaaccatgacgcctgcacgttcaaacgctggcagatttactttcattcctgtctcctgagagattcaaaatttgcgcgcgataatagcataattcaaacggctaccagccacttccgccagcttgcctgcaccagcgcgcgctctttgctaaaacacgtctgcgccacatgaccgggaagctcctgcaacgccaggtggtgcagttcatcacgcagtgtggtgtaggctaccgtcagcgcctgcgcctcgtgttcatccataatgccgttttgcgccagaagctccaggatgcgcacgttatcagaccagcgcgttaatttaggtttttcatgagcgtagcgcagtaccagatattgcgcgataaactcaatatccgtaataccgccttcatcagctttaatatcaaaacgatcacgatgcttattgccgagatgcgcccgcattttctcgcgcatttcacgcacttcagtctgcaatgtcttgccgtcgcgcgccgtcgtcatgatagtgcggcgcaccgcatcaaactgtgaggtaagctgcgggtcgccatataccacgcgagcgcgtaccaatgcctgatgttcccaggtccaggcttcatgctgctgataatcggcaaacgcgtccgctgaagtcaccagcattcccgccgcgccagaggggcgtagacgcgcatccacctcatacaaaatgccggaggaagtgcgcgtactgaacagatgcataatgcgctgcgccaggcgcagataaaactgccgcccgtcgatttcgcgttcgccgttggtcatgacgtccatcggacagtcatgcaggaagatgagatccagatcggaactgtagcccagctcccatccgcccaacttgccataaccgacaaccgcaaacccccgcccctggcgctcgtccagatgcgctggctgaccataacgcgcaaccatttgcgtccacgcctgctgcaccacagcatcaatcatcgcctccgccagccatgtgaggtgatcgcttactttcatcaccggcagcgtaccggcaatatccgccgccgcaatccgcaaaagctgtgcctgtttaaactggcgtaatgcctccagttgttgttcttcgtcctcttccggcacgcgcagcaaatattggcgtaattcgtcgcggtaagcgtcggtagccgtcggctgataaagcgtgccggggtcgagcagttcatcaagcaacaacggataacgcgccaattggctcgctatcattggcgaagcggcgcagagcataatcaggtgtttcagcgcgccgggaaattcgctcagcagctccagataggtggtgcgagtgacaatccccgccagcaacggcgttatccgcgatagcgtaacagcggcgtcttcgcgagaacagacatcagcaagcaggtgcggcatcagttggtccagcacttgccgcccgcgcgggccgatagggcgtttatccagttccttacggaagtcagcgatgagggtcagaacctgtcgccgctcctcatcggctaaatgcgccagcactggcgtcgaatcatcctcctgtagcgcatcctgccatacttcacgccacggctctgaacgttcttcctcctgcggggtatcggcttcatcatcgccaattaattcgttgaatacgcggcgtacattagccatatgatccgtcagttcaccaacaagctgcggccagttctccgccttcattccccaggccagccgcgcccgattcagatcgtcggcaggcaacgtttgcgtctgttcgtcattgatgctttgcagcagattctccagacgacgtagaaaaagataggccacgcgcagttgcgccacgtcattctcaggcagcaaatgcagcgcagcgatagcatccagcgtcggcagtaacgaacgcgactgtagcgacggctcgcgtccgccgcggatgagctggaatacctgcacgataaactcaatttcacgaataccgcccgcgccaagtttaatgttgtctttcaaaccgcggcgtcgcacttcgcgggcgatcatccctttcatattacgtagcgactggatgacgctgaaatcgatatagcggcggaaaacgaaaggccgcagcatggcgcgtaattcacgagaccaggcgtcgtcgttatcgcccattagccgcgctttcaccatggcgtagcgttcccagtcgcgtccttgctcctgatagtaatcctccagcgcggcaaaactcagtaccagcgggccgctgtcgccaaacggtcgcaggcgcatgtccacccgatagacaaaaccgtccattgtgggctgatccagcgctttgatcagccgctgcccgagacgcgtaaaaaactgggcgttatcgagttcacgacgcccgccccgggtctcgccatgttccggccaggcgaaaatcagatcgatatcagacgaaaaattcagttcgccgccgcccagcttgcccatgcctaaaatcaacagcggctgcggaacgccctgcgggttacagggggttccccattcgcggcaacaggcggcatacagccagtcgcgcgcccccacaatgagcgtctccgccagatggctcaactgttgtaaaatagtctcatcgtccaccagcgacagcgtctgtgcccaggcgatgcgtaccatgatgcgacgacgaaaaaacctcagttcacgcatcagcgaggcgtcgtcacagacacctgccaacgcctcctgtaaccagccagcataatgtcgccattcatcagcctgcggcgatgcggattccagttcggcaagccactccggatgcgctatcacgctatccagcgcaaaatcgctaaatgtaagtactgacttcgcctgcacgctaagcgatgtctcagtaaatccttctggtaggcgctcaacaacggtctgccagtactgcgataagggtgaagagagcggcgtcatttaggggatatcctttaaataatgccgggtggcggcgtttcgcctgatccggcctacaagtccgcataccgtaagcctgataagcgcagcgtcatcaggcgctttctacggttctgattatcgttttccgctgtgcaaccagaacggctgctggttgatggcctcattacggaaatgttcaatttcaatacgttgcccggtaataatggcgtgacgcaatccctgccagttctccagccatgcctgcgcgaccatcgcatcataatacccggccagcagtaaaacgctgtcaatatcgcgagtcaaacgcggcaactggtcgcgatatttatcacccagcggttgtccaaaaactttttttaattcagcagcatgacgagaaagatgaatgtcggcgaaacgcttaaaagaatcggccattttggcctgcgccttcgcgtccagaaatggctgccaggctttcgtcaccagccattccgtcaatgccagtttcgccatcgccgtttgcgtactataaacggctgtgacggcggacaccgcggatgtcatcgtcgcttccgcctgggtaagtagatcacgtaagtgagcgctcgctttacgcggaacaatgccaccaaagagcattaaggcatggcgcaccaaccccatagcatccagcacgtgttctttcgccgacttgtcgccgcgcagccagagctcttcatggtactgccactgtgacaacgccagatccagcgaggcctccagcccttgctctaccgtggctttcgcggcggtccgcagaattgtcgttggtgtattctctcgcggcgcattcccctgcgccaggtgataacctcgcgccgccttactcagactgccctgacgcaaaccggtttgcgacagcagttgcttcgccagttttaacacggcgcgcgtatcgccgcgaagcaactcaagctccagctcacaaatcggttcggcaaactcgcccgcttttacgtcgccgagatcgagcgcaatttcaatcctgctgccgtcaacgtccagacaccatttttcccggtaaaaatcggtactgaacagcggctgtacgcttgatgccaggccggcgggcaggttgccatccggccagacctccgccggaagttgcgtcagatccagcacgggttcgcttagcgcgacattgtattcgggtcgctggtgcagcccccccgttacccggccggcaattttcatggtcatttcatagcgcccattttcaccacgaatacgcagccccatatcatggcggcgtagccagttatcaggcgtttcgaagtagatattcagcaactggctgggcgcatgatgctcgccgccgagcgtatgaagatgatttcgcagcgcatctacggcgtcgtgattgacgataaactttaattcgatttcctgagccatggccttgtacttatgggttatgtcacatctgggaagattcttggcgaacttacccgcattatttttgtcagtagatagtattttgcgccaaattgccatgcaacgagcaatttgacgggcgtaaaagtttgacgtagcggcaaaggcgacacagatgattccgattgatgtcgactactttgcgtagcgacactgatgccgttactatcgttccactttctctgacaataacgacagcctgatgccaaaattacgcctgattggactaactttacttgcgcttagcgccaccgccgtctctcatgctgaagagacgcgttacgtttctgatgaactgaatacctgggtccgcagcggtccgggagataattatcgccttgtgggtaccgtcaacgccggcgaggaagtcacgctcttacagagcgatgccaactatggtcaaatcaaagacagttctggtcgtactgcctggataccgttaaaagaactgaataccacgccaagcctgcgtacccgcgtgccggatctggaaaatcaggtcaaaacgttgactgataaactcaacaatattgataccacgtggaatcagcgcaccgccgatatgcagcagaaagtggcgcaaagcgacagcgtcatcaacgggctaaaagaagagaaccagaagctgaaaaacgagctgattgtcgcgcagaaaaaagttagcgccgcgaatctgcaactggatgacaaacagcgcaccattattatgcagtggtttatgtatggcggcggcgtattgggtattggcttgctgttagggctggtgctgccgcatatgatcccaagccgtaaacgcaaagaccgctggatgaactaaatcgccttctctgcggcactgtcttatcattagaggatgatcgtttttaaaaggaaagtggcgtgaagatttatctggtcggtggtgcggttcgggatgcgttgttagggctaccggttaaagataaagattgggtcgttgtcggcgccacgccgcaggagatgcttgatgcgggctaccagcaggtaggccgtgattttcctgtgtttctccatccgcaaactcacgaagaatacgcgctggcgcgtactgagcgtaaatccggttccggctacacgggcttcacctgttatgccgcgccggacgttaccctggaagccgatctccagcgtcgcgatctgaccattaatgctctggcgcgcgacgatgccggccagattatcgacccttaccacgggcgccgggatctggaggcacgtctactgcgccatgtctctcccgcgtttggcgaagatcccttgcgcgtattgcgcgtggcgcgttttgctgcccgttacgctcatcttagtttccgtatcgccgatgaaacactggcgctaatgcgcgaaatgaccgcggcaggcgagctggaacatctgacgccggaacgggtatggaaagagacggaaaatgcgcttaccacccgcaatccgcaggtttacttccaggtattgcgcgactgcggcgccctgcgcgtcctgtttccggaaatcgacgccctgtttggcgtacccgcgccggcaaagtggcatccggaaattgataccggagttcatacgttgatgacgctgtcgatggccgccatgctcagtccgcagcttgatgtccgtttcgccacgctttgtcatgatctgggcaaaggcttaacgccgaaaaacctctggccgcgccatcatggccacggcccggcgggcgtgaaactggtcgaacagttatgccagcgtttgcgcgtccccaatgacctgcgtgatttagctaaactggtcgccgaataccatgatctgatccacacctttccgatactccagccgaaaacgatcgttaagctgtttgacgccattgatgcatggcgtaaaccgcagcgcgtcgagcagattgcgctgaccagcgaagccgatgtccgtggacgtaccggatttgaagcgtcggattacccgcaggggcgctggctgcgcgaagcctggcaggtggcccaagcggtaccgacgaaagaggtggtggaggccggatttaagggcattgagattcgcgaggagctgacgaagcgacgaattgcagcggtcgccaactggaaagagaagcgctgcccgaaccccgccagctaaacgccatccggcacgataaattgcctgatggcgctgcgcttatcagaccgacaaaacagttaggccggacaaggcggtactccgccatccggcacggtcaatcatcagaagaagacaacgtaaacggcagccgccaccacaaagcggtaaatcgcaaacggaataaacgagatacgcttaatcagttgcaggaaggtcttgatagcgatcagcgccaccacaaacgccgtcacaaagcccaccgcgaacattggaatatccgctgcggtcaggaatgaccaacttttgtagagatccagaaccgttgcgcccatcatcatcggcacagccagtaagaacgagaactcagaggcggcgtaacggctgacgcccatcagcatcccaccggaaatggtcgctccggaacgcgagaagcccggccacagcgccagacactggaaacagccaatcataaacgcctgacgatacgtcatatcatccagccccggcgcgcgcggttctttcggcttcaggcactcggcggcaatcagcaacagaccgcctaccaccagcgcgtacatcacgttaattgggttaaatagcgacttgatcgtgtcatgaaagactaaccccagcaccaccgccggaatcatgcccagcaggatgtgaatcaacgttaatcgacctttactttcaccttcacgctgtagcgggcggccaaagtgaataccgatgagaccaaacaaccgccgccagaacatcaccacgaccgccagaatagatccaagttgaatcaccacttcgaatgtcttggccgtatcgccttcaaaccccagcagatgacccacaataatcatatggcccgtgctggataccggcaaaaactccgtcaatccttcgaccacacccaaaattgccgctatcagcagcgagtgcatatcgctcatcaataaacccctaaaatgaaaaacactgcaaaaatggatctcgcgttaagaccccatatataaccgtttggtttaaaaaatataaaattatttatttttatttcagattattgccacgctcaataattacccctacgttcgccgcgcgcgcgacggcgccaggcttactcagtttgatgcgaacccacggagaattgaatcggctaagcagcagatccgccacctcttccgccacacgctcgaccagagcaaaacgcccgccttcaacatgatttatcaccgtgtcggcgatatccgcgtaacttagacaatctgcgacatcatcgcttttcgccgacttgcggttatcccatgccatttcgatatcgaacaccagtttttgctcgatagtctgttcccagtcgtaaacaccgatagtggtgattaccgaaagttgctctataaatacaatatccatcacgacctgcctgctttttggctaacccggataccacttccggcgaaatgtgcgtattatccacagaaatagtaaataaaacgacactttcaatacggaacagcttatgagtgcaatcgcgcctggaatgatcctcttcgcgtacctctgcggctcaatttccagtgccattctggtttgccgcatcgccgggctgcccgatccgcgagaaagcggctccggcaacccgggcgcgacgaacgtattacgaatcggtggcaagggagcggctgtcgcggtacttatttttgacatccttaaaggtatgttgcccgtctggggcgcgtatgcgttaggcgttacccctttctggctggggcttatcgctatcgccgcctgtctggggcatatctggccggtcttttttggctttaaaggtgggaaaggcgtagcaaccgcgtttggcgccatcgcgcccatcggctgggatttaaccggcgtcatggcaggcacctggctgctgacggtcctgttaagcggttattcatcgttaggggcgattgtcagcgccttgattgcgccgttttacgtctggtggtttaaaccgcagttcaccttcccggtatcgatgctgtcatgtctcattttgctgcgccatcatgacaacatccagcgtctgtggcgtcgccaggagacgaaaatctggacgaagctgaaaaagaaacgccagaaagattgagctggagctgcgtctggaagagggccgcaaccgtctggggatcggcccacaagggttgaccggcaatagctcggttgatgggcttacatatcgaatccgccgcgcgtcacccttccaccattggcgtggttaggcgcgattttcggcctgatcttcctggtgctgctgatcgtctccaggctgttgtggatgcccgtcgttttgctgtaaacccgttggggcggcatgatgtcgccccctttctccgcttttacgccgccggcagctcggccagcggccagcgcggacgtaccgttacgccaagatccgccgtaacgcccgccttaaaccgcaccattccggcataggcgatcatcgccccgttgtcggtacaaaactccggacgcgcatagaacacttcgccgcggcgtttttgcatcatttcggcaagcttcgcgcgcagcgtgcggttagcgctgacgccgcccgccatgaccagacgcttaaaaccggtgctttccagcgcgcgcttgcacttgatcatcagcgtatccacgaccgcatcttcaaaagcgcgcgcgatatcagcgcgagtttgttcgtcgccgccattactacgaatggtgttagcggcaaaggttttcagaccggaaaaactaaaatccagccccggacgatcggtcatcgggcgcggaaagacaaaacgccccgccgtcccctgcgacgccattttcgacagcatcgggccgccaggataatccagccccaacaatttggcggttttatcaaacgcttcaccggcggcatcgtcaatcgactctcccagcagttcgtactgaccgattccggtcacgctaatgagctgcgtatgtccgccggagaccagtagcgccacaaacgggaattccgggggattatcttccagcattggcgccagcagatgaccttccatatggtgtacaggaatggccggcacattccaggcaaatgccagtgaacgcccgacggttgcgccgaccagcagcgcgccgaccaggcccgggcctgcggtataggccaccgcgtcgatatcgctcgccgtcagaccggcttcttttaatgccgcctgaatcagcggcacggttttacgcacatgatcgcgggaagccagttcaggcactacgccgccgtagtcagcatgtaatttcacctgactatacaattggttggctaacagaccctttttgtcgtcgtaaatagcgatgccggtttcatcgcaggatgtttcaatacccagtacacgcatgacttgttttacctcgctctaataccgcgcagtgtaggtcgaatgcgggtggatgtataccctcagtcccgacttcgtgtatactccctccccttataaaagtccctttcaaaaaaggccgcggtgctttacaaagcagcagcaattgcagtaaaattccgcaccattttgaaataagctggcgttgatgccagcggcaaaccgaattaatcaaaggtgagaggcacatgccggtaattaaagtacgtgaaaacgagccgttcgacgtagctctgcgtcgcttcaagcgttcctgcgaaaaagcaggtgttctggcggaagttcgtcgtcgtgagttctatgaaaaaccgacgaccgaacgtaagcgcgctaaagcttctgcagtgaaacgtcacgcgaagaaactggctcgcgaaaacgcacgccgtactcgtctgtactaatcttttgagagcgggctgctctcaattcagatcgagttgtagttgtaaggccgtgcttccgaaaggaatgcgcggcttgttttcgtttatgcattagcatatacacaaaatcattcatgctgcgtccaggcggcaagagagtaaatccccggcgcttacgcaagtcagcgacaggggtgagcaaacgtagccaacactacggcagcctgaagaatgacgtgtataaaaggggcatatggctggacgaatcccacgcgtattcattaatgacctgctggcgagaaccgatatcgtcgatctgatcgacgtgcgcgtaaaactcaagaaacagggcaagaactatcacgcgtgttgtccattccataatgagaaaaccccttctttcaccgtaaacggtgaaaaacagttttatcactgctttggatgcggcgcgcatggcaatgcgatcgactttttgatgaattacgacaagctcgaatttgtcgaaaccgtcgaagaattagcggccatgcataacctggaaattccctatgaagcaggcaccgggcttagccagatagagcgccatcaacggcaaaacctctatcagttgatgaatggtctgaatgacttttatcagcagtcgcttacccatcctgcggcaaaacctgcgcgtgactatctgcaaaagcgcggtctgagcgctgaaattattcagcgtttcgccattggcttcgcgccgccagggtgggataacgcgttaaagcgcttcggtaataacagcgataacaaggcattgttgctggatgccgggatgctggtcaataacgagcagggcagcacttacgatcgtttccgtaatcgggtcatgttccctattcgggacaaacgcggcagggtgattggttttggcggtcgagtactggggaacgacacgccgaaataccttaactctccggaaacggacattttccataaaggccgccagctatatggtctttatgaggctcagcaatatagtgctgaaccgcaacgcttgcttgtggtcgaaggttatatggatgtcgtcgcactagcgcaatacgacattaactatgcggtcgcttcgctgggtacctcaaccacggcagaccatatgcatatgttattccgggcgacgaacaacgtaatttgctgttacgacggcgaccgggctggccgtgatgccgcctggagagcgctggaaacagcaatgccttatatgaccgacggtcggcaggtacgctttatgtttttacctgacggcgaagacccggatacgctggtgcgtaaagaaggcaaggcggcttttgaagcgcggatggagcaggcgcagccgctctctacgtttctgtttaatagcctcctgccgcaggtggatttaagctcgccggatggcagcacgcagttagccgcactggcgctgccgctcattaatcaggtgcctggcgacgcacaccgtattcagttgcgccagacgttggggctgaagttaggcattttcgatgatagtcagcttgatcgtttagtgccaaaacaggcggaaagcggcgtttcccgcccggctccgcagctaaaacgcacgaccatgcgtatactgataggattactggtgcaaaacccggatctcgcgccgttagtgccgcccttagacgcgctggatcagaataagctgcctggacttggcttatttaaagaattggtcaaaacttgtttggctcagccaggtcttactaccggacaacttctggaactctaccgtggcacaaatgatgctgcgacccttgaaaaattatcgatgtgggacgatatagcagataaggcgattgccgaaaagacctttaccgactcactcaaccatatgtttgattcgctgctgcaactgcgacaagaagagctgatcgctcgcgatcgcactcacggtttaagcagcgaagaacgccgagagctctggacgttaaaccaggagctggccagaaaatgaatttaacggcttaaatgccgcatatcgatcgggaagcccccgacagccgcagtgagaggcagcggccaaaatataagtatgccctcgctttaaatgtcgacagctataccgtcgacaccaatcaaacgaataagtgtggataccgtcttatggagcaaaacccgcagtcacagctgaaacttcttgtcacccgtggtaaggagcaaggctatctgacctatgctgaggtcaatgaccatctgccggaagatatcgtcgattcagatcaaattgaagatatcatccaaatgatcaacgacatgggtattcaggtaatggaagaagcgcctgatgccgatgatctgctgctggctgaaaataccaccagcaccgatgaagatgcggaagaagctgctgcacaagttctgtccagtgttgagtctgaaatcggtcgtacgactgacccggtacgcatgtatatgcgtgaaatgggcactgttgaactgttgacccgggaaggcgaaatcgacatcgctaaacgtatcgaagacgggatcaaccaggttcaatgctccgttgccgaatacccggaagccattacctatctgctggaacagtacgatcgcgttgaggctgaagaggctcgtttgtccgatcttatcaccggctttgtcgatccgaacgcggaagaagagatggcgccgaccgcaactcacgtcggttctgaactctcccaggaagacctggatgatgacgaagacgaagatgaagaagacggcgacgatgacgccgccgatgacgacaacagcattgaccctgaactggcacgcgaaaaattcgctgagctgcgcgcgcaatacgtcgttacgcgcgacaccatcaaagcgaaaggccgcagccatgctgccgcgcaggaagagattctgaagctgtctgaagtgttcaaacagttccgtctggtaccgaagcaattcgactatctggtcaacagtatgcgcgtgatgatggatcgcgtgcgtacccaggaacgtctgatcatgaagctctgcgtcgagcagtgcaaaatgccgaagaagaactttatcacgctgtttaccggtaatgaaaccagcgaaacctggttcaatgccgctatcgcgatgaacaaaccgtggtcggaaaaactgcacgatgtcgcggaagaagtgcaacgctgcctgcaaaaactgcggcagattgaagaagagaccggtctgaccatcgaacaggtgaaagacatcaaccgtcgcatgtccatcggggaagcgaaagcccgccgtgcgaagaaagagatggttgaagcgaacttgcgtctggttatttctatcgctaagaaatacaccaaccgtggcttgcaattccttgatctgattcaggaaggcaacatcggtctgatgaaagcggtagataagttcgaataccgtcgcggctacaaattctccacctatgcaacctggtggatccgtcaggcgatcacccgttctatcgccgatcaggcgcgcaccatccgtattccggtgcatatgattgagaccatcaacaagctcaaccgtatttctcgccagatgctgcaagagatgggccgcgagccaacgccggaagagctggctgaacggatgctgatgccggaagataaaattcgtaaggtgctaaagattgccaaagagccaatctccatggaaacgccgatcggcgacgatgaagattcgcatctgggtgatttcatcgaggataccaccctcgagctgccgctggactctgccactaccgagagcctgcgtgccgccactcacgacgttttggctggcctgaccgctcgtgaagcgaaagtgctgcgtatgcgtttcggtatcgatatgaacaccgaccacacgctggaagaagtgggtaaacagttcgatgttacccgcgaacgtatccgtcagatcgaagcgaaggcgctgcgtaaactgcgccacccgagccgttctgaagtgctgcgcagcttcctcgacgattaattcgccgcacacgtataaacgccgccgcaaggcggcgtttttttatcaggccatgcgcaagcgccctatttggcctgcagaatttctacacagcgcgagtattcgcgccctcattccccattgctatagcccacgcataatgagcgcttgatccagttcgcgataggcctcgaccagtttttccgttttaattcggtttaagccgctgggattcggcaacacccacaccatcgtcgcgccaatggcgatcttttgtttaccccaggcgataccgcgctggctgaacccctgttcaaaagcctgtttaccaagcaccgccagcgccgcgggctggtagtcctctattttttcaatcaggtttcgtccgccgctacgtaattcatgcaacttcacctcagtcgcttgtaccgtcggtcggtcgacgagtttcgttaccccgcagcgaaaatccagtaatttttccgcctcttccggtttcaactgtcgatcggtgaaaccggccaaatgaataactttccaaaaacgattcgcgggatgcgcaaacggaaagccggtattcgccgaggagagtcccggattgatgccgcaaaaaaccacccgtagccctggcgccagtatgtccttaaccattattactcctgagcaatacaacgttctttaagtataacgggttgaaaacacattgtttataaaaacagcacccgcacggttacggctggattacagcgtaaagttacattataatccaccgccacggccccttagctcagtggttagagcaggcgactcataatcgcttggtcgctggttcaagtccagcaggggccaccaaattttagctttaaaatcatataattaagccactctaaagagtggcctttttgtttctgacagggctcaccccataccgctatttacgatgccaataggctgccgcacgtaccaggtgtggatcaaaccccttttcaaagcactgacttaaacgttttaccgttttgccttcgccagtaatccagatgaaatagtctgattctggtattgtcagctgcgacaggcgcgtttgcattgcctgttcatcgccgccaacaacatattccacagtaatatccgtcaaatgggcgagataatcgcggtatgccgcatcctgaatgctcaccagcgcggttaccgcagggcgcacaggcagacggctaagcgattccagacgacgacgtagcgcaggcataccggactcatcgcagacataaacctgacaggcatactcttccggcaccaccagcgaaccgcgcggcccgccgatcgtcagtgtatcgccttcacgggcttccattgcccaacggctggctacgccgccatcgtggataaagaaatccagcgccagctcgcgacgcgcctcgtcatacagcggcgtgtaatccctggagaccgggcgaacgccctccccccagataatgccttcctcagtgactgtcggaggcgtaaagcgacagcctggctcagggaaaaaaactttcgtgtgatcgtcaaagcccagggagatgaaaccgtccagcgcctcgccgccaagtacgatccgctgaaatcctgcgctaatacgttctacccgcagaacgatcagctcgcgaaaacgcagctcattacgaacacgctgtgggtagcgtacggatgatgtcgtcattttttgccttcgtgaagtaatacgatatatctaaattaaagttttaaatgataatgattgttaatcagtaaaaatgcaactgttttttgatagtgttctggcaacacatcgctaatcacaacttcaaaataaaacgttataaattaatagattatatcaacaatcgcttttatccttgctaaaaaccatcatttagatataaattagatatatctaaataagcaggaggcaatgatgcaaaatcaacatgaagggtgttgcaaaaaccgggatcatatgcacgatggttgctgcaaagatcgagaacatcagcatgaaggctgccatagcgcgcatcagcatgagaacgccagttgcggcggcgagcaccgtcacggacacggctgtggtcgtcatggacagggcggtggtcgacgtcagcgattttttggccacggggaacttcggctggtcattcttgatatcctgacccgggacgccagccacggctatgaactgattaaagcgatagaaaacctgacggggggcggctatacgccaagcgctggtgtgatctaccctacgctggattttttacaggatcagcaatttatcacgattagcgacgaagaaggcgggcggaaaaaaatcgcgattaccgcgaacggcgcgcaatggcttgatgaaaatcgcgaacacctgacgcatattcaggcgcggctaaaagcccgttgtgtgggcatggagttacgtaaaaatccgcagatgaagcgggcgctggataacttcaaggccgtgctggatctgcggataaaccacagcgatatcaacgacgcgcaaatcaaacgcattatcggcgtgattgatcgcgcggcgctggaaatcgccgaactggattaagcgggctgcgtgtcctcttcgcggacgcggaacacgttaaccagctcttttaaatgtaacgcctgttcgttcagcgacgccgcggcggcaacagactcttccacaaggcaggagttttgttgcgtggcggcgtcaatcaggccaatcgcgctgttaatctgcgaaataccgtcagtttgctcacggctggcctgcccaatctcgcgtaatatcacatccatctcttcgacgttatccaccatgccattaatcagggcgctggctttctccaccaggtgcatcccttcctgagtctgactggttgaatcttcaatcaaattacggatttcactggctgacgaggcgctcttttgcgccaactggcgaacctctccggcgacaacggcaaaaccacgtccatgttcgcccgcacgcgccgcttcaaccgccgcgttcagcgccagaatattggtctgaaaggcaatggaatcaatgatattgatgatatccgacatacgatttgccgtatcgttaatgacgcgcattttctgcgtcacttgattcatcatctccccattgtttttcactacgctggcggcgccggcagagagtttggtcgcttcactggtatggtcagctgtgtttttaaccgtggcggtaatctgttccatcgacgccgccgtttcttcaaccgagctggcctgttcttccgtacgcgcggccaaatcctggttaccggcgacaatttgcgccgccgccgtggagatactctccgaaccgttttgcacttcctgtacgatatccagcagacgcgttttcatcgccattaatgcttgcagtagtacgcctgtttcatctttatagtcggtggtgatatggcgagtcagatcgccatcggcaatcgcctcggcaaagcgtaccgcttcatcaagcggtcgggtaatggaacgtacgatataccatcccattacgcatccggcagcgatgcttatcagcgccagggtaattaacagcgtccggttagttttaaaatctccttcgacctgcacgcccgcgttgtgcatctgcgcatcctgaacggcgataagttcctgaactttgtccttatagaccttttgcacttgcaccgttctggtcatcatctcctgaatggccgcctgacgattatggctttgaatatcttgcaaaatacggaatctggactccaggtattgctggcgcgcttcacggatctcggtaatgattttctgcgaagccgcatcgtgacgattgctggaaagctcatccagtaacgccgtaatacgctggcttatttcatccagctctttctgcgaactctggctccagcgcccctcttcatccagtaacatgagctgctgcgcgatgatgaaatcattaaaattatcgattaacagattggctttcaccgtggtgggataatcattggtaataatgttctgcatacccgtattagcccgatcaaggctaaacaaagacagagcggaactcaccaccatgagaacaatgaataagccaaaggccataaataattttgaacgtattttaatgttatgcaaaaacatattttctccctgggattgcatatcctcatacaggaagatttatcggcaataatgttactaactttatgatattgatcgctttttatttcggaacattattagtaagtaatatttattgttcacagaaagatgaaccaaaagtgacataaattggcactaataatgaaagaaatacgctaaaaggttaaccatttcttatttattaactgagtttatacctattaataggtagacaagggagaaggaataaatatcacattatttttaacatcacaggccactgatactctctatgatggcaggcaccgccttctatcagagcgcatccgcccggtaagcctgttgctaccgggcggatgtcattaccattgctacctacaaataaacttaatgcagtaccgtgaccgcatcctccagccggctggcacggtgttttaccattgcggagacttgtgcgctctcttccaccagcgccgcatttttctgggttatgcggttcaactcgtccacggcgcgggtcaggctggaaagcccatctgtctgttcctgcgtcgactgactgatacgtgcgataagcagggtgacattttgcacctgagctacaatgtcatccatggtacggcctgcggcgtgaacctgctcggagcctgactgcacctttgttgcgctggcatcaattaatttacgaatatcgttcgccgcattagcgctgcggctggcaagatggcgtacctcgccagcaaccacggcaaaccctttcccctgctcgcccgctctcgccgcttctaccgccgcattcagcgccaggatattcgtctgaaaagcgatatcgttaattagcgtggtgatcgtcccgatacgttgcgtactgtgagcgatatcatccatcgttttaatcaccgtatccatcgcctcacctccctgagtcgccgcgctactggccgccatggaaagcttatccgcagcggaagccgtctcggaattgagcttcacggactccgccatctggttcatggtcgttaccgtttcctgaacattctccacggtctgacgggtgtgttcgttcagatcattattacccttcgccagcctttcactgccgtttctgacgctggaaacctgacttgatacgtcattgatcagccagcggcacatcaagccaagctgccccacggccctcagcgtcagccccaactcatcgctacgattaagatgttgtacgctgttgcgttcgccggtcgccactttcagcgcctgcgtcgccacattttcaatgggacgcacaatttgccattccaatagcgccgtacctgccagcatcgccaacgcgcccaacagcaacgcctgccatgaggcatccgtaccgaacaacgccaacgccagcattacggccattagccccataatgctacgcactcgccagcgaacaggcatagcgggcagtttgcccagcaaaccctgacgaaccaccaggcctttatgaattcgtttactacaccgcccttcatttagcgcctgatataaaggctcgacggcggcaacctcatcatccgtggcgcgggtacggatcgacatatatccagtcacacgcccttcacgtatcatcggtaccgcgttggcccgcacccaataatggtcgccgtttttacgccggtttttcacaatgccgctccacggttcgccctgttttagggtgtaccacatatctgcgaaggcagctttcggcatatccggatgacgcaccagattatgtggctgcgccagtaactcgtttaactgatagccgctcacttggacaaaagtgtcattggcgtgagtgatatagctttccaggtcggtcgtagacatcagagtggtatcatcatccagcggggtatttagctggctgacgtagggatgagaagacatgatagcgtcctgtgcaggttatctggatgttaatttttcgctcagatgttatttcggcgctaatctatttatctttagttgttaaaattgctctggatcgcaatttgcgattaatccttaatatttgtacgattttcacctcatcctgcgccttattttcattatgaaattgtttagcgtggacaacctttttctttaaaatctgccctggctcacctttttctcacgccgccgctaacgcaacacaccgtaaaccgtaaaacaagatctgctcaaaatgcatccaattgttaacgcatgatattaaatgttgggtaaatgtgattattcctggtgtttatcccgattttcactatgggcttagacccccgctaatccctgcaatacttaattcagtatcatgtgatacacggccctctggagctcattttgaacaggttaccttccagcgcatcggctttggcctgtagcgcgcacgcactgaatctcatcgagaagcgaacgctaaaccatgaggaaatgaaagcactaaaccgagaggtcattgactactttaaagagcatgtaaatccaggatttctggaataccggaaatctgttaccgccggcggggattacggagccgtagagtggcaagcgggcagtttgaatacgcttgtcgacacccaggggcaggagtttatcgactgtcttggggggtttggcatctttaacgtggggcaccgtaatcctgttgtggtatccgccgtccagaatcaactcgcaaaacaacctctccacagccaggagttacttgatcccttgcgggcgatgctggcaaaaacgctggcggcgctgacaccggggaaactcaagtacagctttttctgtaacagcggcaccgaatccgtcgaagcggcgctaaaactggcaaaagcgtatcagtcgccgcgcggcaagtttacctttatcgccaccagcggcgcatttcatggcaaatcattgggcgcgctctccgccacggccaaatccaccttccgcagaccctttatgcctttactgccgggcttccgccatgtgccgtttggcaatatcgacgcgatgagcatggcatttagcgaaggcaaaaaaacgggcgacgagatagcagccgtgattctggagcctattcagggtgaaggcggcgtgatcctgccgccgcagggatacctgacagaggtacgtaagctctgtgatgaattcggcgctctgatgattctggatgaagtacaaaccggcatggggcgtaccggcaagatgtttgcctgcgagcacgaaaatgtgcagcctgatattctgtgtctggcgaaagccctgggcggcggcgtgatgccgattggcgccaccatcgcgactgaggaggtgttttcggttctgttcgacaatcccttcctgcataccaccacttttggcggtaatccgctggcttgtgctgccgcgctggcgaccattaacgtcctgctggagcaaaatctcccggcccaggcggaacaaaaaggcgatacgctcctggatggttttcgacaacttgcgcgtgaatatcccaatctggtacacgatgcgcgcggcaaaggtatgttgatggccattgaatttgtcgacaacgaaacgggctaccgttttgccagtgagatgttccgtcaacgcgtgctggtcgctggtacgctgaataatgcgaaaacaattcgtatcgagccaccgctcacgctaaccattgaactgtgcgaacaggtattgaaatcagcgcgtaatgcgctggcggcaatgcaggtgagcgttgaagaggtttaaaaacgatgccggatggcgctgtgcttatccggcctgttttccccgggtcgcggcctcttttttgaatcccatcacaatcaccacattccccttttcccttttacctcgcgacggctacagtagtaactcatccgaccacataacaataattttacatactggatacgcttatgagctacccgtcgctgttcgccccgctcgatctgggctttactactctcagaaaccgtgtgctgatgggatcgatgcacacgggtctggaggaacatcctgatggcgctgagcgcctggcggcattttatgccgagcgcgcgcgacacggcgtagcgttaatcgtcaccggcggtattgcgcccgttccctccggggtcgtgatgaccggcggcgcgatgctgaacgatgccagccagttaacgcctcaccgcgtggtgaccgatgccgtacatgcgcaaggcggtaaaatcgcgctgcaaattctgcacaccgggcgttacagctatcagccgcacctggtcgcgccgtcggcaattcaggcgccaatcaaccgctttatgccgcatgaactgacgcatgatgaaatcttgcagttaatcgacgacttcgcgcattgcgcgcaactggcgcgggaagcaggctacgacggcgtagaggtgatgggatcagagggctatctgattaatgaatttctcacgcggcgaactaaccatcgcgatgacgaatggggcggcgactatgccagccgtatgcgcttcgcggttgaggtagtacgcgcggtacgccagcgggtagggaacgactttattattatctatcgcctgtcgatgctcgatctggtggaaaatggcggcacgttcgacgaaacggtacaactggcgcaagccattgaagccgcaggcgcaagcctaattaataccggcattggctggcatgaggcgcgaatcccgaccatcgccacgccagtaccgcgtggcgcctttagctgggtgacgcggaaactcaaaggtcatgtgtcggttccgctgatcgcgaccaatcgcattaacgatccgcaggtcgccgagacgatcctgacgcgcggcgatgccgatatggtgtcgatggcgcgtcccttccttgccgatgccgaattcctgactaaagcgcaatccggacgcgcagatgagatcaacacctgtatcggctgtaatcaggcctgtctggatcggatcttcatcggcaaagtgacctcctgtctggtgaacccgcgcgcctgtcacgaaacccacatgccgataacgccggccatacgcaaaaagaacctggccgttgtcggcgcaggcccggcggggctggctttcgcgattaacgccgcgtcgcgcggccatcatgtcacgctgtttgacgctcagagtgaaattggcggtcagtttactatcgccaggcagatcccgggtaaagaggagttttacgaaacgctgcgctactaccgtcgaatgatcgatgttactggcgttacgctgaaactgaaccaacgggtgaacgcagaggatcttcagccgtttgacgaagcgatcctcgcttgtggaatagtaccgcgccgcccgccgatagacggtatcgatcatccaaaagcattgacctacctggaggtattgcgcgataaggcgccggttggtaagcgagtggcgatcatcggctgcggcgggatcggttttgacacggccatgtatctgagccagcacggcgaatccaccagccaaaatattgctgaattttgtacggaatggggaattgataccagcctgcaacaggcaggcggtctgcgcccggaaggcccgcgcctggcacgtagtccacggcaaatcgtcatgctgcaacgcaaaaccagcaagccgggcgaagggttaggtaaaaccaccggctggatccatcgcgcgacgttactggcgcgcggcgtgaagatgatcccggcggtcagttaccagaagatcgacgacgacggattacatctcttgatcggcggcgaaccgcagttgctggaagtggatcatgtggtgatctgcgccggacaggaacctcgccgcgagctggcggacccgttacgcgccgcaggtaaaacggtacatcttatcggcggatgcgatgtcgcgatggagctggatgcccgacgggcgattgcccagggcacccgactggcactggagatttaacgactttgcctgatggcgctacgcttatcgggcttacgccgtcataccggttttataggccggtatgacgcttgagcgccttatcgacggcgtccctgcttcaccgctttcaaaatgacaaatttattgttggttgctatcgtcgcgcaattaccgaaaatcttcttcagcttgtggaaatagtccagatggcggttcgccacaatatacagttcgccgttgattttcaggcagcggcgggcgtgatggaacatctcccaggcgatattgtccgtcagcgcatgtttctggtggaacggcggattgcagaacaccgcgttaaaacggaacggctccacgccggagagcgcgttgttgatcataaattcgcagcgttcgaatgcttccggcaggttcgtttctacattcaaacggctggaatctaccgccatcggcgattcatcgacaaatactacgttcgcctgcggatttttcgccagtaagctcaggccaatcaccccattgccgcagccgagatcgacaatctccccgtcgaggttttccggcaaatgctgcataaagaagcgcgcgccgatatccaatccggtacgagaaaacacattcgcgtggttgtgaatcgtccagcctgtatcttccagtttccagcttagcgtttgcggcgcgtcggccagttgcggatgactgaaggtacagttaatcaggcgcgctttcttccacgccagcgtcgtcgtggttgggcccagcactttttcaaacagttccagcgtagaggtatgaatatcacgcgctttcgcgccggcgataatacgcgtttgcgccgtaacgaccttacgcaaagcgcgtaactgctgttccagcaacgccagcgttttcggtaccttaatcaataccacgcccggcgcctgcgggtagtcagcggtactgtcgagaaacgttacgctggactccgcgatgccgttatggcgtaaattctctcgcgtacccagttcgcttaaatacgaatcgccaatactgtatggcgaatgctccgccagcgcacagcttagcgcgccaaacgtatcattcaggatcagcaccgggccgcgaatttccgtctcatccaactgttgcagcagatactcatcggccgcctcccacgccagaagcgggttaacatcatccgtttgcggaaaacgtttcagcgtcagtgaacggaaaccgtcgtctacgtggctcattaggcctcctgaatggtaaaattgcggcgttatccctgaaaagggtgcgtgagtatacactttttatcagcaacatggagctttgatgacctcactaacttaccttcaggggtatccggaacatctccttgcccaggtgcgcgccttaatcgccgagcagcgcctgggagcagtgctggaaaaacgttatcccggcgcgcatgattacgccactgacaaagcgctatatcactatactcaggaactgaaaagtcagtttctgcgcaatgcgccgcccattaataaagtgatgtatgacagcaagatccatgtgctgaaaaatgcgctgggactgcataccgctgtctcgcgcgttcagggcggcaagctcaaggcaaaggcggagatccgcgtcgccaccgtgtttcgtaacgccccggagccattcttacggatgattgtggttcacgagctggcgcacctgaaagagaaagatcataacaaagcgttttatcagctctgctgccatatggagccgcagtaccatcaactggagtttgatacgcgactgtggctgacgcatcaggcgctgtcggcacaataaattctgaaaatgccccttcccccgtatctttttaacggcgtgggcataaaatcggcgcgttcacatttcgctcattgcctgccgccacgtcaaggatgacgatctgtagagggtattttttatccaccgccaacggaaccgcgcaacgaccatgctctcacaatgtgcccgttttatccgccgcctctgttttacacgccgggccttaacagtggcgtgttttctgcttgtcgcagcaggcgtcgcgcttttctattccaactggcttatcgtcaacgcctcacagcatctgacatggaatgacattcagaccgttcccgcccgcaacgtcgggctggtgttaggcgccaaacccggcaatcggtattttacccggcggattaatactgccgccgcgttgtatcacgccggtaaagtgaagtggctgttagtcagcggcgataatggcaaaaaagagtacgatgaaccttcggcgatgcagcaggcgctgatggcgaaaggtgtgccggaggcggccattttttgtgattatgccggattctccacgctggactccgtggttcgcgcccggaaagtgtttggcgaaagccgcattacgattatctcgcaagcatttcataatcaacgggcgatctggctggcgcaacaatatggcattgacgctatcggcgttaacgcgccggatctgaataaaaggcacggaacctacacacgacttcgggaaaagctggcgcgggttagcgcagtgctggatgccaaaattttgcatcgtcagcctaaatatctgggcgctggcgtcactattggggctgatagcgcacacgggtgcccttctcgccagtaaaatgccagagtgcgtcgcagcgcactggcaagggcggaaaggcgtgctacattgacgaaaaatccctttctggagtccgctgacgtttatgatacgtttcgctgtaattgggactaactggatcacgcgccagtttgtcgacgccgcccatgaaaccggcaaattcaggctcgccgccgtttactcccgtagtcttgaacaggcgcagtctttcgcaaatgattatcccgtcgagcatctgtttacctcgctggaagcgatggcgcaaagcgacgcgattgaggcggtttatatcgccagcccgaattccctgcatttctcccagacgcagcgctttttgcagcataaaaaacatgtcatgtgcgaaaagccgctggcttctaacctggcggaggttgatgccgctatcgcctgcgcgcgcgataatcagcgggtactgtttgaagcctttaaaaccgcctgcctgcccaatttcctgctgctgcgggaatcgttgccgaaaatcggcagaatgcataaagcattactaaattactgccagtactcttcacgttatcagcgctatctgaacggtgaaaatccgaatacgtttaatccggccttctccaatggttcgattatggatatcgggtattactgtctggcgtcggcgatcgcgctatggggcgagccgcgcagcgttcaggcgtcggcgaatttattggaaagcggagtagatgcgcacggcgtcgtggttatggattacggcgattttagcgtcacgctacagcattccaaagtcagcgactcggtactggccagtgaaattcagggcgagaggggatcgctggtcattgaaaagctgtcggaatgccagaaagtgtgttttgcgccgcgcggcgcgctgatgcaggatctgacccagcctcagcatattaataccatgctgtatgaagccggggcgtttgcccagcttattgaaaaccacgccgtggaacatccggggttgtcgctaagtcgcgccacggcaaaatggctgacagaaatacgccgtcaaaccggggtcatcttcccggcggacgatctgacccatccccttactgcgtaaaattatgtaaatcatatgttacaggtcattgactctacgcgtggcctgtcatactttgttacgcgcaaaggggagtaacttcattgccggtcgatcgtcattacgatgtgtgcaaaaccacatccggtcaccgggcagccataaaggaatgcgtcagcgtattcctttattgttgtaagtgagaccttgccgaatggcaaggtctatgcataaaagcaacggctaatgccattcggcgttagccgttttttttttttgcatagggagaaataatgaatactgttggtacgccattattatggggtggattcgcggttgttgtggtgataatgctatccatcgacctgttgttgcagggacgccgtggcgcacatgcgatgtcgatgaaacaagcggcaggatggtcaatcctgtgggtaacgctctcgctactgtttaacgccgctttctggtggtatctggctgaaacgcaagggcgcgaagttgctgacccgcaggcattggcgttccttaccggctatctgattgagaagtcgctggccgtagataacgtctttgtctggctgatgctgtttagctatttctccgtccctccggctctgcaacgccgggtgctggtgtatggggttcttggcgcgatcgtgttgcgtactatcatgattttcgccggtacctggcttatcactcagttcgaatggctgctgtatgtgttcggcgccttcctgctgtttaccggcgtaaaaatggcgctggcgaaggaagatgaatccggcattggcgaaaaaccgatggtgcgttggctgcgcgggcatctgcgcatgaccgatacgatcgagaacgagcactttttcgtacgtaaaaacggcctgctgtatgccacgccgctgctgctggtgctgattatggttgagttcagcgatgtgatcttcgccgttgacagtattccggcgatctttgcggtcaccaccgacccgttcatcgtactgacctctaacctgtttgccatcttaggactgcgcgcgatgtacttcctgctgtccggcgtggcggaacgcttctcgatgctgaaatatggtctggcggtcattctggtctttatcggcattaagatgctgatcgtcgacttctaccatattcctatcgcgatttcgctgggcgtagtgtttggtattctgaccattacgctggtgattaacgcctgggttaaccatcagcgcgataagaaactacgagcgcaataatcttttatcggggtaaacctgccccgtcaaaaacgcccgacagcgcacacctgtcgggcgtttttgtttaacatgtcacaatactgttaatataaagttataaaacatgatcacagcaaaaaatccaggatatttcgcttcccgaaccttcaactttccttatactcaaccaggcaaacactttgttacatcctgaaagatgcgccgtaagagcgtgcaggggatgaccagcaacacaatacaaggaatatgaaatggctacgcaacgagcatcagggctactgcagcgtttagcgcaaggcagtctggttaaacaaattttagtgggtctggtactggggattttactggcatggatttctaagcctgcggcagaagcggttggcttgcttggcaccctgttcgtcggcgccttaaaagcggtcgcccccgttctggtgctgatgctggtaatggcctcgatcgccaaccaccagcacggccaaaaaaccaatattcgccctattctctttctttacctgctaggcaccttttcagccgcgctggcggccgttgtgttcagcttcgccttcccttcaacgctgcatctgtccagtagcgcccaggatatcgtgccgccgtccggcattgtagaagtcttgcgcggtctgctgatgagcatggtgtcgaaccccatcgacgcgctgctgaacgctaactatatcgggattctggtatgggccgtcggtctgggatttgccctgcgtcatggtaatgaaaccaccaaaaacctcgtgaacgatatgtctaacgccgtgacctttatggtgaaactggtgatccgtttcgcgccagtcggtatttttggtctggtttcatcaacgcttgcaaccaccggcttctccaccctgtggggctatgcgcacctgctggtcgtcttgattggctgtatgctgctggtcgcgctggtggtcaacccgctgttggtattctggaaaattcgtcgcaacccttatccgctggtgttcgcctgcctgcgtgaaagcggcgtttatgccttctttacccgcagctctgccgccaatattccagtgaatatggcgctgtgcgaaaagctgaatctggacagggatacttactccgtttccattccgctgggcgccactatcaatatggccggcgcggcaattaccattacggttctgacgttggcggcagtccatacgttaggcgtcccggtggatctgcctacagcgctgctgctgagcgtggtggcctcgctgtgtgcttgcggcgcctccggcgtggcaggcggttcattgctgctgatcccgctggcgtgcaacatgtttggcatcccgaacgatatcgcgatgcaggtagtagcggtcggctttattatcggcgtattgcaggattcgtgtgaaacggcgctgaactcgtctaccgatgttctgttcactgcggcagcctgccaggcagaggacgaacgtctggcgaataacgccttgcgtagctaagtgattatcgatgccggatggcgtatgccatccggcgtaacgatagatctgaatctcccaatccataggctgtgatggaaagcgaattgatgttcacgcgcaacatcctcgcgtaacgttatatgtagatggcgtctgccgcggcgctcggtcagcgtaaagtataaagtgtcagcctgtgtaaatcctctcgccaccctcccttgcgataagcaaaatcaaagctcaacgacgcgtaatttctataacggacttcgttgacctttgttacaattagatgcattttgaatttttgtgtgttagtgcttgcttacttcacaacttaacaaggaatagttcaggccgcgaatttgccgtttccgcaacgctgataaaaactccaactctgttgcggcagtgcaaacctcagatcaccggcgtgacgttaaccgattctccaggaatactgaatggaactactgactcaattgctgaatgccctgtgggctcaggactttgaaacactggccaatccttccatgattggcatgttatattttgtgttatttatgattttgtttctggaaaatgggctgctccctgccgcctttttgcctggcgacagcctgttgatcctggtcggcgtgctgatcgccaaaggcgcgatgggttatccacaaaccattttgctgcttaccgtcgcggccagcctgggttgctgggtcagctatattcagggccgctggctggggaatacccgcaccgtgcaaaactggctctctcatctccccgcacattatcatcaacgcgcccatcaccttttccataaacacggcctgtcggcactattgataggccgttttatcgcgtttgtcagaacgctgctgcccaccattgccggcatatccggtctgaataacgcgcgctttcagttcttcaactggatgagcggcttgttgtgggtgcttatcctgacgtcgctgggctatctgctgggcaaaacgcccgtctttatgaagtatgaagatcagttaatgtcatgcctgatgctgctgcccgtggtgctgctcttttttggcctggcgggttcactggtcatgctgtggaaaaagaagtatgggagccggggataacttatgcttaaaccacgcataactgcccgacaactcatttggatcagcgcttttctactgatgctgaccatactcatgatgacgtggtcaacgctgcgtcagcaagagtcgacgctggccattcgcgcggttaaccagggcgccagtatgccagacggcttctcagttctgcatcatctggatgcgaacggcattcattttaaaagcattacgcctaaaaatgacatgttgctcattaccttcgattcccctgcgcaaagcgccgcagcaaaaacagtgcttgatcaaacgttaccacacggttatgtcgtcgctcagcaggacgatgacaacgaaacggtacagtggctgtcccgcttacgggaaagctcacaccgctttggctaatctccaggaatccgaatcatatcactcactttggtgatttcattgtttaatgactatgattaataaagcggtgtttaacccaccgcgttattatcgggatcaccgccccggacaacgggtccgaacataagggaaagttcaggaatgaaataccgcatcgctttggctatcacgctttttacacttagcgccggtagctacgctaattcgctttgtcaggaaaaagagcaggatatacaaaaggaaattagctacgctgaaaagcacaacaatcagcgccgtattgagggtctgaacaaggcgctcagcgaagtacgcgccaattgtactgacagcaagctgcgcgccgagcatcagaaaaagatcgctgagcaaaaagaagaggtagccgaacgccaacgtgatttagccgaggcaaaagcaaaaggcgatgcggataaaatagacaaacgtgaacgtaagctggccgaggctcaggatgagctaaaaaaacttgaggccagagactactaaattaacgccgaatgtaaatactcactcacctggagaaaactatgtcgaaagataacactacggaacatctgcgcgctgagttgaaatccctgaccgatacgcttgaagaagtgctgagctcttcgggcgaaaagtcgaaagaagagttgagtaagattcgtagcaaagccgagcgcgcgctgaaagagagccgttaccgcctgggcgaaacgggtgatgtgattgccaaacagactcgcgtcgccgccgcccgcgccgatgattatgtgcgcgaaaatccctggacaggcgtaggcattggcgccgctgtcggtctggtgttgggcgtactgctgacgcgtcgttaattatggcggactctcgacaggcacaaggaccaggcaaaagcgtactgggtatcgggcagcggattgtcaccattatcgttgagatggtggaaacccggctgcgactggcggtagtagaactggaagaagagaaagcgaacctctttcagcttttgctgatggtaggtcttaccatgctcttcgcggcgtttggcttaatgagcctgatggttctggtcatctgggctatcgatcctcagtaccgtttgaacgcgatgatcgctaccacagttgtgctgttagtgcttgcgctaatcggcggcatctggactttgcgcaaagcgcgtcagtccacgctattgcgccatacgcggcacgaactggctaacgatcggcaaattctggaggacgatcagtcgtgagcagcaaaggcgaacgcgaaaaacgtaaagcgctgcttctcagtcagatccagcagcaacggctggatctgtccgccagccgtcgcgactggctggagaccaccggcgcgtacgatcgcggctggaatacggtgttaagcctgcgctcctgggcgctggtcggtagcagcgtaatggccatctggaccatccgtcatcctaatatgttggtacgctgggcgaaacgcggcctgggtatctggagcgcctggcgcctggtaaaaactaccctccgtcaacaacagctccgcggttaatatcttttcttttatagcatcgcgccatcaggttatcacctggtggcgcgatacttttatgcatatcgtctctttagcaatcactcaaattttttgaaaaaatttggcaattttccttgctaacaattcctgcacgccacgtttatgattctctccagcgataacaatgatgcgccaaaccgcgtcattgctcatgaaaatagcagcagccgccgaatcggccccctggagaataaaatgaaaaaattagaagatgttggtgtactgatagcgcgtattttaatgccagttctgtttattaccgcaggatggggaaaaattagcggctatgcgggcacacagcagtatatggaagcgatgggcgtaccaggattcctgctgccgctcaccatactgcttgagttcggcggcggtctggcgattctgctggggttcctcacccgcaccactgcgcttttcaccgctggttttacgttgctgacggcattgatcttccatagcaattttgcagaaggtgtaaactcgctgatgtttatgaaaaacctgaccattgccggcggattcttattactggcgttaaccgggcctggcgcgttcagccttgaccgtctgctgaataaaaagtggtaagcaatctatactcaattaaaaaagcgagggaatagcgcctcgcttttgtcatctgaaggagagagacatgggacaactgatcgatggcgtctggcacgatacctggtatgacaccaaatcttccggggggaaatttcagcgttcagcgtcggctttccgcaactggcttaccgctgacggcgcgcccggaccttccggcgaaggcggattcgccgcagaaaaagatcgttaccatctgtacgtttcccttgcctgcccctgggcgcatcgcacgctcattttccgtaaactgaaaggtctggagccgtttattccggtttccgtcgtgaatccattgatgctggaaaacggctggacgtttgatgatacttttccggcggccaccggcgataccctctatcagcatgaatttctctaccagttgtatctgcacgccgatccacactacagcggccgcgtcaccgtaccggtcttatgggataaaaaaaatcatactatcgtcagcaacgagtccgccgaaatcattcgtatgtttaactccgccttcgatgggctgggcgctaaagccggggattactatccccccgcgctgcaaagcaaaattgacgagttaaacggctggatttatgacaacgttaataacggcgtttataaagcaggcttcgccaccagccagcaagcgtatgatgaagcggtagacaaggtatttactgcgctggcgcgcctggaacagattctcggacagcaccgctatctgacgggcgaccagttgaccgaggcggatatccgcttatggacgaccctggtacgctttgatccggtttacgtgactcatttcaaatgcgacaaataccgaatcagcgactacctgaatctgtacggtttcctgcgcgatatctatcaaatatcgggcattgctgaaactgttaatatggaccatattcgtcaccactatttccgtagccataaaacgattaaccccacgggtatcatttctgtcggaccgtggcaggatctgctcgaacctcacgggcgcgacgtgcgctttggctaatttcaggcgtcctccgggacgccttattaataaataccacaaatatttaccagcatttcattcgcggctattcttagtttgattactttaaaaacaagtgattgaaccattattgaggcgaaaatggattggtatttaaaggttttaaaaaattatctgggatttggcggccgcgcgcgacgcaaagagtactggatgtttattctggtcaatatcatctttacctttgtgttgggcctgctggacgccatgcttggctggcaacgcgccgggggtgaaggcgttctgaccaccatttacggcgttctgatctttttaccgtggtgggccgtgcagttccgtcgtctgcatgacactgaccgctccgcatggtggctactgttgctacttatccccattatcggctggcttatcatcatcgcgttcaactgccagaatggtacgccgggcgacaaccgcttcggccccgatccgaaacgtttttcctgatggcggcgcggcgccgcttttaaagcgccgcgcgctatttattttccggcgaatagcttaggtatttcccgcaggcaccaggcttttgcctcccccatactgtcgcgccgccaggccataataatatcgatttcgctggtcgattccgggctgaccacgcgtagccgcccttcggcaatatcctgttccaccatcgaatatggcatggtcgcgacgccaagcccggccagcagcgcctgacgtttatcttcaatcgtgcttaccgtcagacgtggctgcttatccagcagttgcaccgttaataccggccgctcgcgcgcggtatccgctaccgctacgccgcggtatttaacccgcgtcacttccgaaagcggctccggctcctgatgaatagggtggtcaggcgcggcgacatacacattcattaacgtatacaacttacgggagttaatttccgacgacgatcgaaaatgcatatccggagcgataacgatatccgcccgtccctgctcaagccgctcccatgcgccagccagtacttcggtaatcaatgaaagctgcgtattggctttagcggccagccggtcgatcagtggaaaaaaagcaggcgtcggtaccagagcttcagtgactagcgtcagatgcgtttcccaaccgcgggccaacgcttcagcatccgtcgttaacttgtctgccgcttccagcaatacccgcccgcgttccagcagcatacgtccgacgttggtgaattttgtacgatggccggagcgatcgaacagtacaacgtccaactcttcttccagcttctgcatggtgtaactcagcgcggagggcacacgccccaactcatcagccgctgcggcaaaactgccccggcggtcaatggcgtccatcacacgcaatgcttcaagcgtcagcgctctctctttagccataacgttctcattcaggaaatttgaacataccgggcagaatatctggctaacaatgcagcgtccagccccttaacataaaaggaagtaaagagaggttaataacgatgattacgacccgaaccgccaaacaatgtggacaggcagactacggatggctacaggcccgctataccttctcctttggacactatttcgaccctacactgctaggctacgcgtcgttgcgcgtactgaaccaggaagtgctggcgccgggcgcctcttttcagcctcgaacttacccaaaggtggatattttaaacctgattctggacggcgaagcggaataccgcgacagcgacggcaaccatgtacaggctaaagcgggcgaagcgttactgctcgccgcgcagccgggcattagctacagcgaacataatatcagcaaagttaagccgttaacccgaatgcaactgtggcttgacgcctgtcctgaacgggaaaacacgctggtacaaaaaatcccactcctggcggcgcaacaacagcttcttgcctcgcccgacggtgagcaaaacagcttacaactgcgccaacaggtctgggtacatcatattacgctggagaaaggcgaatcgcttaatttccagcttcacgggccgcgcgcctatttgcagtcgattcacggtacgttccacgcgatgacgcacaacgaagaacgcgaggcgttaacctgcggagatggcgcatttattcgtgatgaacctaacattacgctggttgccgatacgccgctgcgcgcattactggtagatttaccggtgtagccagccagaaaaggagtcgcaagatgagcaaaaaatcggcgaagaaacgtcagcccgtggtaaaacctgccgtacaggaggcgatgagcgccgctgtgccgctgggctatgaagagatgctaaccgaactggaagccatcgtggcggacgccgaagcccggctggcagaagaagaggccgcagcctgaaatcatgccggatggcggcgcaagcgcccgatccggctgataacgggtagacccgataagcgcagcgccatcgggcaacacgctgccccgacgtcatgccggggcgttattattaatgcgctttactggccataatctcgatgatctgcttgtcggtctgctgcattgagcgacacgccagcgaacacaaattcgaaatagattgttcgacattgtgcgccacaatcccttcgtttccggtcaccgccgtatcatccaacgccatcagtacggctttccacgccgccgacgcgctggtagagactttcatcgcgcagctattcgacgcgccatcgcaaatcatcccgctgacatcaccaatcatactgctgatagccattgcgatagtgtcgtaacgaccatctatcagccacgccatacccgctgccgcgcccatcgccgccgtagttgccgcgcacagcgccgacaaacgcggaagctgatggtgaatatagatagcgctcaaatgcgataacattagcgcgcgcgccaggcgctcgtcatcggcgccgacatgttcagcaaccaccatgactggcaccgtggcggtaatcccctggttgccggagccggagttgctcatcgcgggcaacgtggcaccgcccattctggcgtctgacgccgcgctggtacggatcaaaatcgccgtggagagatctttcgccagcagaccgcgatcgcactgtttggccagcgtcgaaccgatatgcagcccccaggaaccacgcagtccctcctgcgacaacgcgccgtttagcctggccgcatcgagaataaagcggatagcgtcaaagggcaccgcattcacaaacgccaggatctcttccagcgaggtatgagacagcactcccagtggcgaggttttttcttcttcctgcgcattatcggcctgggtaaataccacacccttgtcggtttctatccgcacaatatttgtatgatcgccgacgatcgtgacacatgcccagctatcgccgctatacactttcgcccgtgaaaacagaatatcgttacatggctcctgcaacatcaccgcgacatgtccagcggccagcatcgcttttgcatcggcaacggctttagcggaagcgtcttttaacacctccaacccggctttcgcatcaccgcccaacgcgcccaacgccgcggcgatcggtagccctaccattcccgttcctggaacggtaacgcccataccatttttcatcagattgggcgaaacccacgcgtcaatgcgttcaactgtgccgttaagttcagccgccgccgccgctgccgccagcgccagtgaaattggctcagtacaccccagcgccggttttacttcttcctgtacggccagaataaaactttgccacaatggatttattttagattcaaacataacaacaaccttaatctcaggtatatcaagagaatgccaggaacggagaaacgcatagcagcagaccggtaataataatcaggtacaacgaagcgcctttatatttgtgcaatgcgggaaccttgtagaccaaccatgccggaattaaacagcccaccataccgaagatagggctacaaatagaggtgaagctcagtaccggcgcgttgagcacaatggcgctccaggccagcaaaatagcgaaaatcataatgccgcgctgtaccagattttccttaatcttctcggcgggcattttacggcgcaggatattcatcacaatgccttgcgtcgcttcgcggaatcctaaataaacgccaaagaaggcggtcatgacggcaaagatgttcagaattacgctaaccactttgacccagccagcgccatcgccgctaataaattgcgcggcgatcgccagggcggaaatattctgctcgtaggctttcaccgcttcgtcatgccccatcgccagggtgaaggaaaccgcatagaaaaatacggtaacgaacaggatgccaaacgcaatattcatggcacgcagcgctttatggcgtgcgacctcaatagatttttcgcgtgaacggtaagagatcaccattgggcttaacgtctggataaataaaatcgaggtcagcgtaaatggcagggtaataatggcgtttttaatcagcagggccatcggcggcagcgcgccaatgttatacagatgccacatacccaccatagagacgcccagcgccgccactaccagtagcttggtcagcaccatgccagtggagattttgaacagtaatttttcaccgcgtgaggaaatcgccaccaggatgcagatcagcaccagaccataaaatggactatcggaaagcaatccttccgttacgccgaaagtatgcagataagaggcgctgtcgttagtaatcgccgtagaatagacgaacatccagatgacgagcatcacaaagtacagcgcgcctaataaaataccccagtttttgcccagatagccgctgatcacgctggggtagtctttacattccggggattccgccagcgtattaataaacagccgctggaacaggtacatggccggatagccaataatagaagagagtaaaaagacccaaagtcccatcaggccaacctggacaggaagaaaaacgatccctgcgccaatcgccatcccgatactcataatgacccaaccggtgtcggtactatcaaatttgatggcttcacgccattcgctttcagtcatccctgcccgacgcgccggggctgatgcgtcgaggattacgctggtattacttgccgattccataaaattctcgctcaatgtgtaggtagaggttttttttatttttcgtgccgcagcaaggcgatatgcagaacgtgaggtgcaggtactttcttgtaataagaaaatcatacgcgcacgataagagaaaaacttaccaataaaacgcctgcatttcttgtgggttaagaattcttttctatttactattggtttaatgttgttattttctctatttgacgcgtatcacaacaaaaaagggcgcactttggtgcgcccttttctcaacttctgtcttctacgttatcccatagcctgctcactctgcgcctgtcgggtctatccacaaacgactttaatcgccagaccgccgcgcgacgtctcgcgatatttgtcgttcatgtctttacccgtttcgtacatggtttcgattactttatcgagcgaaacccgcggttcagaggtacggcgtagcgccattcgcgccgcatttaccgctttaacggcgttaatcgcattacgttcaatacaagggatttgtacctgacccgccaccgggtcacaggtgaggccaaggttatgctccatcgcaatttccgccgcaatacagacctgcgccgggctgccgcccagcagttctgtcagccccgccgccgccatcgaacacgcgacgccaacctcgccctgacaccccacttccgcgccggatatcgaggcgttcatcttgtacagcataccaatcgcccccgccgacagcagataacgggcgatagagttggcattgaccggacgacggaatttgtcgtaataggccagcaccgcaggaataatgccgcacgcgccgttggtcggcgcggtgaccactcgcccgcccgccgcgttctcttcgctcacggccagggcgaacatgttaatccagtcaataacgttcatcggatcgcgggagagattatcgctggagaccagcagacgccgtaacgctaccgcgcggcgtggaacgttcagcggccccggcagcacgccctcagtattcatgccacgttcaattccggtcgccatcacctgccagatgcgggcaaagccagcgtcaatctgctctttgctccgcaacgccagttcattttgcatcatcaggccggaaaccgagagcccctgtctttcacacagcgtcaacagttcgctggcggaatgaaaatcatacggcaccgatttttctacgtcgtgcgactgaccaaaacgctcctcttcgacaataaagccgccgccaatagagtaatacgttttgtgtaaaagcggcgcttgtccgttccaggcggtaatacgcataccgttttcatggcgcgccagggtttcagcgtgaaagaaaatactgtcggcgacgggaaaatccaccacatgcgcgccacccgccaccgataaacggctgctgcgggcaacctcctggataaacgccggaatgctatcaatattgacatcctgcggcgtattgcccgccaggcccataatgacggcggtatcggtcgcgtggcctttgcccgtcagcgatagcgatccgtaaagatcaaccgtgatgcgcgtcgttcgcggcaggtcgccgctgtcgatcagccgatcgataaaacattttcctgcattcattggccctacggtatgggagcttgaaggtccaatgccaatcttaaaaatatcaaatgcgctaatcatatctccccctaagattaccgttcagcgaagatccgtcgcggggcgatccacacgatcgccccgttcacgttacatcgcctgagtaaaggtgcgcgaaataacgtcctgttgctgttcacgcgtcagcgcattgaagcgcacggcatagccggaaacgcggatcgtcaggttcgggtagttttccggatgttcaatcgcatccagcaacatttcacggttcatgacattgacgttcagatgctgcccgccttctacctgtgcttcatgatggaaatagccgtccagcaggccgacaagattggttttccgcaccgcatcttctttcccgagcgccgcaggcacaatcgagaaggtgtacgaaataccgtctttggcgtaggtaaacggcagtttcgccaccgacgtcagcgaggccaccgcccctttgcggtcacgaccatgcatcgggttcgcccccggcgcgaacggcgttccggcgcggcgtccatccggcgtattgccggtcttctgcccgtacacgacgttcgaggtgatggtcaaaatggactgcgtcggcaccgcattgcgatacgtcggcaacacgctaattttttgcataaagcgtttcaccaggtcgcaggcgatgctgtccacgcgctcatcgttgttgccgtactgcggatactcgccttcaatagcaaagtcgatggcaaggccgttttcgtcgcggatcggcttcacctgagcgtacctgatggcggacagggaatccgccgccaccgacagtccggcgatgccgcacgccatcgtccgatacacatcacggtcgtgcagcgccatcagcgaagcttcatagctgtacttatcgtgcatgtagtgaatgatgttcagcgcgctaatgtactgcaccgccagccagtccataaaatggtcgagactctccattaccgcgtcataatccagcacctcatccgttaacggcgcggttttcggcccgacctggattttcagtttctcatcaacgccgccattgatagcgtacagcaacgttttggcaaggttggcgcgcgcgccgaagaactgcatctgcttaccgatgaccatcgggctgacgcaacaagcgatggcgtaatcgtcgctgttaaagtcggtacgcattaaatcgtcgttttcatactgcaaagatgaggtcacgatggagacctgcgcagcatatttcttgaatgccaccggcaacgcttctgaccacagtatggtcaggttcggctccggcgctggccccatcgtgtgcagggtatgcagataacggaaggagttcttcgtcaccagcgtgcggccatcaagccccatcccgccaataacttcggtggcccagatcggatcgccggaaaagagcgaatcaaattccggcgtgcgcaggaaacgcaccatgcggatcttcatgatgaaatggtcgatcagttcctgcgcctgctgctctgtcagaaggcccgcgttgaaatcgcgctcaatgtagatatcaaggaacgaggcggttcttcccagcgacattgcaccgccattttgcgattttaccgccgccagataagcgaagtagagccactgtaccgcttcctgcgcgttccgcgccgggcgggagatatcgtagccgtatttcgccgccatctcctgcatttgcagcagcgcgcgacgatgctccgccaactcctcacgcaggcgaatcgtcgcctcaagattctgtccctgctccagattcgactgcaggtcggcgaattgcagctcgcgttcgcgcaccagataacggatgccatacagcgcgacgcggcgataatcgccaataatgcgcccgcgaccataaccatccggcaaaccggttaatacgccggatttacggcagcgcagcatatccggcgagtaaacatcgaatacgccctgattatgggttttccgcaggtcggtaaaggtatattcaaaatcggcgtccatttcgcggccataagcgtggaatgaacttttgatcatgttaacgccgccaaacggatgcaaagcgcgtttaagcggcttatccgtttgtaaaccgacgattttttccagctctttttcaatataccccgcatcgtgcgcggtaatcgtcgtcgcgatgttggtatcgaaatccaccggcgcatgggtcgcgttctcgatacgtattcccgccatcaccttttcccacagcgccgtggtcgctggcgtcgcgtcggcgagaaaagattcatccccctcatagggcgtatagttatgctgaataaaatcacggacattaatttcttctttccagtccgtacctttaaaatcacgccatgcttcggcatacagcatatcgctggtatcgatatttaccttcatgaaaaataatctctctacagaacagccgttaagttatgcaaattccactggtgctttcacgttgcctaaatgaatggcatcaagggcaatcattttctcttcattcgtgggaataacagcgcaaataacctgagaagggttagcggaaataatgcgctcgccgtgagaattcggctgcttattcatttcaacgtctaacgtaagccccagtacgcccagatgttcaatgaccaactggcgaattaatactgaattttcaccaataccaccggtaaaaataatgccatccaaccgatgtaacgatgccgcgtgtccggcaatatgacgggcgatacggtgaacaaacgtttttatcgctaaccgggcgcgctcatgtccttcgtgccaggctttttccaggactctaaggtcggatgacaaaccggagatgccgagcaaaccggactctttattcaccactcgctccagatcgctcaacgtctgcccggtttctttggctatccacgccatcgcgccgaaatcaacgtcgccgctgcgagtccccatcatcagcccctcaagcggcgtcatccccattgaagtatccacgctctgaccattgcgtaccgcgcagatagacgccccattgcccagatgcgcgacaatcagacccgagtctttttcatcgaggtcaagcagttcatacgcgcgccgcgaaacatagcgatgcgacgtaccgtgaaagccgtagcgacgcacgcccaggctggaaaaatactcccacggcaatccgtataaataggcttccggcgccagcgtctggtggaaactggtatcaaataccgccacctgacgcacggccgggaaaagatgccgcgccgcgtcaatgccgcttaaattagcgtaattatgcagcggcgctaaaggcgatacccgacgaatattatcgataatctcatcggtaataatgacggactgcgtaaataactctccaccgtgcgcgatacggtgaccaattaatgccacgctatccgttaaatcacgtttttccagctcaaaggcaatggcttttaacgcgtcctcataattagagtgtgcgaggtttatcggcttatcgccattaatagataaaaaggcgttttcagtattcattccatctgctattcccgccattaaaacatcacaggtagcgacatccagtacagagaatttgatagaagatgatccgcaattaatgaccagaacgaccggaaattcattcatgtagtgcctccgtcgatgtcagcctgcgtccgcgccctggggcggacgcaggctaaacgtgaggattagaacaatttgtagacaatattcaggatggtcagcagaccaatcagggtgacgaacacgttatccagacgaccacggtacttcgccagcgacggcgctttacgaatggcgtacatcggcagcaggcataacagcgaggcgataatcggcgcgcccatcgcttcaatcaggtccagaatgttcgggtttgcgtaagctacgacccaggtagaccccataatgaagatcatgctgatggtgttaagcttgcccatagagactttggttttatcgcctttataaccaaatttcagcaccaggccgttcagcccttccagcgtccccaggtagtggccgaagaaagatttgaaaatagcaaccagcgcgatgatagacgcgccatactccagcaccgttgcaaaagtagattttgtccccgacaaagaggcgaaatggttggccaggtaggaaagtaccggaatgttctgcgctttcgcatccgccatgttctgcggggagagcgtaaacaggcagctaaaggcgaagaacatcaccacggcgaccatcagcatactggcgcgcgagatgatctgtgaacatttacgctcggtaaattcgcggccaaactctttctcatactcttcacgcttagacaccacgaaggaagagacgatgggcgaaaagttaaaggagaacaccatgatagagatgcccagccacaccgtaaccagtatgccatcgtgcccggtcagcgcgatattactgagatcaacctgatcgataaccgccgagttccagtaaggaatcagcgataatgagattagtaccagactggcgataaacggccataccaggtaactcatcaccttaaccatcagatctttaccaaaccagatcacaaaggccatcagcagcagcaagaacagcgccacgaaaccgcgattcaacgctggcatctgcagctggttttcccaaaacgtcatgaacgtgttagtaatggtgacgccataaatccacagcagcggacaaatcgcaaagaagtaaaggaacgtgataactaccccgcccgttttaccaaagtgctcttcgaccgtttccgtaatattgccggacggattagatccggataaacacagacgcgccagcgcccggtgacaatagaacgcaatggggtaagctaaaaccagcatcagaagaatggggataagcccgccaaacccggcgcggatagggaaaaacagcaccccggcgccgatggcggtaccaaataaacccagcgtccacgtcgtgtccgatttacgccatgacgactgttttgcctggctggatacaatgctatcagtagtactcatatcctatcctcacgaaaagattaagcgtcaactaaacccgtaatttgtgatacccgagaaagatcgatattgccgccagaaataatactgaccgtttttctgttctgaatatggctatctaatttcccacttaatagtgcggcgcaagccagagcgccagcgccttcagtaataaccttattgcgctgaattaaagcgatcatgctgttacgaatttcatcttcgctaaccaggacaatgtcatcgactaattcacgaacgatttcataggttaaattacccgggcgggagacatcacaaccatccgccagggtgccggtcgttcggtgcgtggttatttcgccagtgtaataagacgccgccataccgtgaacattttcggcctgtacgccgataactttaatggtcgggttaatcgatttaatcgcaatggcaatacctgcaattaaaccgccgccgccaataggcacgatgacattatcgacatcgtacagatcttccataatttccagaccaatagtgccctgtccggcaatgacttttggatcgtcgtaaggcggaataaaaatgcggccttcggtttcgacaatttcactcaccttagcgatggtgtcattgaagttgtcaccgtggagcaccacttccgccgaataatcacaggtggccgccacttttgactttggcgcgcccttcggcatcacgactttgccgtcaatacccagcattgcgcaagaaagagaaacgccctgtgcatgattacctgcggaacaggccacgacgcctttacgtttttccgcctccgttaacgagctaagtttgttaaaagcgccacgaattttaaatgaacccgtacgctgcatattttcaaacttgagaaatatttcgcctttgcaacgttcactaaaatagttagagcgaggcattcccgttttatatatcttccccgccagtctttttttcgcttcgaggatatcttcaattgcaaccgggagatcgtatgtaatgtgcattataacctcttaacctgggtattaaaaataagttaccgttgcccactgttcaaaagaaacaggtgacgtcaatttcgctaaatatgtttattccatatcattcaatttctattaactgcctgcgtctgcatccattatatgatgaatattgtttagccaattctactaatactgaagcggcttttttgatacgataatttttagaccataccgccgcataacgtgcgacgggtaacgtgtcttgtatgggtatcgtgataaattgattagagccaaaaggcgtggtcatatcgcagggaataacagttaagaaatcagcattgagaacaagattatatattgtgacgacggaatctgttttaacaatgttttcgatgctgatgccatttcgttgtagagtggtgagtaattcgctgtagtagcccatattcgtttgcggcaacacccactgttcgtcttttaacgattccagtgtgatggtgccggtgcatgttcgggacttgctggctaccaggacaaactctgattcaaacagcggctcgacatgcagatcctgtagctgcatttcattactgagcgtaccgatagcaaagtccagccgcccgtcgcgcagggccggcagaaatgaagagagctgggcttcgtacatggatacctgcgcttttggaaagacctctttgaacttatgaatcatatcggacatgaaggtaaagccaatcagcgaaggaaagccaaacgagacgtcgacaacggtattgcacgtcatactgttcatctcgttgatcatgtttttcatttcgcgggtgatagattcagaccaggaaagcagtacctgtcccgcttcggtcaacgtaacgccggtatttttacgtacaattagctcaacgccaaaataggcctcaacatcgctaatgattttactgacggcgggttgggttaaccctaacgattttgcggcagaaccgatagaaccacttctaatgacttcctgaaagaccaccaaatgctgtgttttagggagaacaagagtattcatatctaccgctctgaaataacattgtgaacggcaggaagtgtagcaaattaaatcttaaaggttatgtgcgaccactcacaaattaacttaccacaatttttacatggtttttattaaataaagaaaacctgatatttcaataggttacaaaaataaagcagtaacttagcctgatttcaatcaaaaaacaggggcgggataacgatatattatggcgataaccagcctattttatctcctatttttgatatcccatgaagacgatatttcaatcaattacgggacattttatcgacaattccagcgttaaatttaaaacgtaatttctcaaatttaagtataaaccgaaggtaaatgcgcttaaaaaccgttacgcgtcacatttttttaccttatttgtttgcaaagaaacatttaataaaattttaaccaaaatatttcatacatttaattttcatttaaaacaaataatttacaccgctttcttgctgtttttcaggatgtaattttgtgaaagaaatcgattgcttttcacttcaactaaaaatagcgcaatacatagcgttttgtgtttctcatcacaaaaacgaataatattatgtcaccacggctgtcaattaattgccggatggtgacgctggcgtcttctgcaacctctatacccttcaccggcctgataagcaaaaacccgccgaagcggattttatgaagaggtgaaactgaccgataagccgctttctttcgggtatagcgtcgtggacagtcattcatcctgtcgccctgtaaaagcaaaaacccgccagcttacactgacggggtttatgaagagatgaaactgaccgataagccgctttctttcgggtatagcgtcgtggacagtcattcatcctgccgccctgtaaaagcaaaaacccgccagcttacactgacgggttttatgaagaggtgaaactgaccgataagccgctttctttcgggtatagcgtcgtggacagtcattcatcctgccgccctgtaaaagcaaaaacccgccagcttacactgacgggttttatgaagagatgatactgaccgataagccgctttcttttgggtatagcgtcgtggacagtcattcatcctgtcgcccggtaaaagcaaaaacccgccagcttacactgacgggttttatgaagagatgatactgaccgataagccgctttcttttggacatagcgtcgtggacagtcattcatcctgccgccctgtaaaagcaaaaacccgccgaagcgggttttatgaagaggtgaaactgaccgataagccgctttcttttggatatagcgtcgtggacagtcattcatcctgccgccctgtaaaagcaaaaacccgccgaagcgggttttatgaagaagtgaaactgaccgataagccgggttctgtcgtggacagtcattcatctaggccagcaatcgctcactggctcaagcagcctacccgggttcagtacgggccgtaccttatgaacccctatttggccttgctccgggtggagtttaccgtgccacggactgttaccagccgcgcggtgcgctcttaccgcaccctttcacccttacctgatcccacttacgtgggccatcggcggtttgctctctgttgcactggtcgtgggtttcccccccaggcgttacctggcaccctgccctatggagcccggactttcctcccctccgcccgtctccccgaaaggacgacgacgaagcggcgactgtctggtcagcttcggcgcgcagtatagtgggttcgcgcgactttgtcaccctgcgctgcgcattcctatcgccagagcggcagcaacatttctggatgcccgataaatattgtcaaaagcgccccgaaaagcctcctccagcgtcacgatgcgcgtgagtacgctaaagacagcgtcgatgccataatgatgtactatccctacatcgtgcgtcaggctgccggcaatgccaattactggcttatgatattttttcgccacatttgcgacgccaatcggcactttaccgcgaatactttggctatcaatccgcccttctcccgtcaccaccagcgtacagtcgtggatatgctcctccaggttcagtgccgccgtgacaatttcgatcccgctgcgtaattccgcaccgagaaaagccattaacgccgcccccataccgcctgccgcgcctgcgccgggtgccgtctttacgtcgacattcagcgatttttttatgatgtcggcatagtgagcaagatttctgtccagctcaacaatgttctcttcggtcgcgcctttctgcggcccaaaaattcgtgatgcgccgttgtcgccgatcagaggattagagacatcgcaagcgacacgaatcgcgcagagttttaaacggggatcgagctctgaaatatcaatgtcgcttagacaatgaaggcttccgccaccgtaaccgatatccgcgccgtttgcatcgcgcagttttgcgcctaacgcctgcatcatccctgcgccgccgtcatttgtcgcgctgccgccaatgccgataatgatattgcttgcgccgctttccagcgcctgcaatatcagctcccccgttccccgcgaggttgtaatcaaagggttgcgtttttctggcggaaccagcgccagtccgctggccgccgccatttcaataaacgcggttttaccatccccggacattccccagcaggctttcactttttcacccaacggcccggtcacccatgcggcgcgttcaacgccctgcgtcgcggcaatcatggcttcgaccgttccttcgccgccatcggcaaccggaacagagacatattgcgcatcggggaaaatttcccgaaatcctttttctatcgcctgcgctacctcggcggcagaaaggctttctttataggagtcgggggcaattacgattttcatagtggtagcctgttactgcacaacgccggatggcgtttcacttatccagtctgaaattcaggcccggatcgctacacgccatccgggcacaacgtcgttagcgagtgacttccactttcgccagtttttcgtagtagcacgccagcgcgctatggtcgtcattaccgtgtccatccgcgcgtaacgcctgcatcatttccataacggcggcggtcagcgggagctgcgcgccaacgccgtgggaggtatccagcgcattcgccagatctttaatgtgcagatcgatacggaaacctggcttaaagtttcggtccatgaccatcggcgctttcgcatccagtaccgtgctgccagccagaccgccgcgaatcgcctgatagaccagatccgggttgacgcccgctttagtcgccagcgtcagcgcttcagacatggcggcgatattcaacgccacgatcacctggttagccagttttgtgacgttgcctgcgccgatatcgccggtatgcaccacggaacccgccatcgctttcatcaggtcgtagtacttgtcgaaaatggctttatcgccccccaccatcaccgacagcgtgccatcaatcgccttcggctcgccgccgctgaccggcgcatccaacatctcaacgcccttcgccttcagcgcatcgctgatttcacggcttgccagcggcgcgatagaactcatatcaatcaatacggttcctggcttcgcgccttcgatgataccgttctcgcccagcgcaacctctttcacatgcggagagttaggcagcatcgtgatgatgacgtcacactgttcagcgatcgccttcgccgtagaggccgtttccgcgcctgcggcaatgacgtcagcaatcgcttcaggattacgatcggacaccaccagcgaataccctgcttttagtaagtttttgctcatgggcttacccatgatgcctaagccaataaagccaactttcatcgtcatagcgttctctctttccataccaggattattttttaaaggtgtcggcaagcttctgcgtgctggcgcggaatgcgcctaaatcgctgccaacggcgacaaaggtcgcgccccattccagataacggcgggcatccgcctctaccggcgccagaatgccgcacggtttaccgtgcgctttagcgcgggcgaaaatatgttgaatcgtctgctgcacgtcagggtgagaagcattgccgagatgacccagcgcggcggccaaatcgcttgggccgacaaaaatgccatcaacgccttccgttgcggcgatggcatcaacattgtcgacacccaactggctttcgatttgaacaataatggtgatgtttttgttcgactgcgcaaagtaatcaggcaccgtaccgaacatattcgcgcggtgagaaacggagacgccgcgaatgccttccggcgggtaacgcgtcgaggcgacggcgcgagccgcttcctcttgcgtttcaacaaaggggatcaggaagttataaaacccaatatccagcatccgtttgataatgaccggttcattggttggcacacgtaccacaggcgcgctggcgctgcctttcaatgccattagctgcggaattaaggtggtcacatcgttcggcgcatgttcgccatccagcaccagccagtcaaatcccgccagaccgagaacttcggtggtgattgggcttgccagtgcagaccagcagccaatctgcacctgttgcgccgctagcgccgctttaaacttattcgggaaaatagcgttattcatcgcttataccttcgcttatttctttaattctctacatgtgatgccgccaccataacttatagcaacgacaataaaatgcttatctgaaatcagaatgggtctccgcattctatttctaatgtggtacacatcctgtagcacaatataccgttctgatatctttatcgtcttttattattatcatggtattttcaaataactcgtcagatacactgaattcgccattcagtataaacagcctatggcggataatcattgtgcaaacgctcattaaaaagggattatttaacgcttatttttgagcatacgcccatgatactgggcgctaatgcacacatttacgctttacccggcctacataaaaaatttcataatttgcggtgatctggatcacattcttatatttatactcctgtcattcttatttcattatgcatgaactttatttcttatattgagatttaacgatttaaccataaccaaaatagataatcctatttctatcatccaggctggagaatgttgaacaatggccaatatcgaaattcgccaggaatcgccatcggcgttttatataaaagtacatgaaaccgataatgtcgcaattattgttaatgaccacggtcttaaagccggaacacgttttccggatggcctggaactgactgaacatattccgcaaggccataaagttgctctgacggatatccccgctcacggcgaaatcatccgttatggcgaagtcatcggttatgcggtacgcgacatcccgcgcggaagctggatcgacgagtcgctggttgaactgccaaaagcgccgccgctgaatacgctaccgctggcgaccaaagtaccggaaccgctgccgccgctggaaggctatacgtttgagggctatcgtaacgccgatggcagcgtcggcaccaaaaatctgcttggcattaccaccagcgtgcactgtgtggcgggcgtggtcgattatgtggtgaaagtgattgagcgcgatctcctgcccaaatacccgaatgtcgatggcgttgtagggctaaaccatctgtacggctgcggcgtggcaatcaacgcgccggcggcggtcgtgccgattcgcacgattcataatatcgcgctcaaccccaattttggcggcgaagtgatggtgattggcctcggttgcgaaaaactgcagccggaacggctgctggaaggcaccgaggatgttcccgccatcgccgttgaaagcgccagtattgtgcgtttacaggacgagcagcatgtcggctttaaatcaatggtcgacgatattttgcgggtcgccgaacgccatctgacgaaactgaaccagcgccagcgcgaaacctgcccggcctccgagctggtcgtcgggatgcaatgcggcggcagcgatgcgttttctggcgtcacggcaaacccggcggtgggttatgcttccgatctgctggtacgctgcggcgcgaccgtcatgttctcggaggtcaccgaagtgcgcgatgccattcatcttctgacgccgcgcgccatcaacgaagccgtgggtaaacgcctactggatgaaatggcctggtacgataactaccttgatatggggaaaaccgatcgcagcgctaacccgtcccccggcaacaaaaaaggcggcctggcgaacgtcgtggaaaaagcgctgggctctatcgctaaatcgggtaagagcgccattgtcgaagtattgtcgccgggccagcgccccaccaaacgcggcctgatttacgccgcgacgcccgccagcgatttcgtctgcggcacgcagcaggtcgcttccggcattaccgtacaggtctttaccaccggacgcggcacgccgtacgggctgatggcggtgccggtcattaaaatggcgacgcgtaccgagctggcgaaccgctggtatgacttaatggatatcaatgcaggcaccatcgccacgggtgaagagacaatcgaagatgtgggctggaagctatttcactttattctcgatgtcgccagcggccggaaaaagactttctcagatcaatggggattgcataaccagctggcagtgtttaaccccgcacctgtgacctgatctattctggaaagcgcctcgcaaaacatggcttaagggccatgttttcatatgtttgataaactgcgccatgttcataccggatatggcaaaaacacctaacccaccataaaaccattcaaattcaataaattgaaattctatgccaagcgcaaccttacgtttctcactaatttgagtcgcagcacatgcaatttgaggtatgtcgaatataacgacagcctattaatcacctttacttaattctgctgcctcatcaattctttaatttgtgccagcgtggacgtgccttccatcggcccacgcgcagagatagccagcgatcctgcggcattagcatgggctaaagcatcgggtacggaatatcccgcaagaaacaggctgacaaaggttgcgccaaagcaatcgccagcgcctgtaggatcaaccaccttcaccggatacccagccacatgatgttgttcgtcttttgaatagtaactggctccacgggcgccacgtttaatgatgacatgggcaattccacgcttgtgaagccttgcgacaattttctcttcatcgcgggatttgctcaggccgaaataatccagttcgccatcgcttggcaggaagaaatccgtgtaatcaagaatatattcaaaggcctgcgacatttcgcggatctttagcatctctttacggatattaggatcgaaagaaattgtgccaccattttcttttacaatgctaatcgccttgcgtacggcatcgatcaaacgaaaggaaaataatgacgatcccataatatgaaagtggcgatattgcctgagtaatgtttcatcaaggtggtcggcactcagcaaaccgcacgcactgtccggcatgttgaaaataaaatctcgctgggcctggcttcggtagctgacaaaagcactacctgttgtggcgttcggcagtacggaaattccctgtacatttacgccatcgcgcgacaatcgggtaatattcataacgccaaaggcatcgttgccaacacagctaaacaacaatgaacgaaaaccaagtttagcaacctgatcggcaaatatggcaggcgccccactgggatacggcccccaaaattcccccggtgaggaaaatccctggttctctttttttgccagaaactcgacgagcaattcacccaatgttgcgattgttatgttcatgcgttgtccttcatcttgcctgatgcagggtcgggtttatccaggtcagacattcgttattggtatagctgttggttaagccgtcggccagaaaccgtgagtggtactcagcggcgacaatctgtggcgtaataatcgcgctcagcgtattcagttttcctaccggataacgcgccacatcatgaatcggacgctgcgccaccacggcaatactctgtccactaaggcgcaggcattcacttagcaaagcagctgcactttcgtttttcacgttgagcgtgccatcctcgctgatatggtccaccatcaccagacaacatgacggttgaaattgttgcaaagattggatggcgatttcgccccccaacgcctgaccactatgccccagtacaccgcccaacaacacaatttcaccatcgatataatcacgggccggtgcaacatggctaagatcgttgatgataaggcacagatcccgataatcgcccaggaaaggaagcgctttacgcaacacctctccggcccccagaaacacggtatcgtcgtcgcagaccagacgggcaacttgcttagccagttcaagctctacgctatgctctaacgcctgcgactgcaccacttcatggcttaccgctgctctgacgggttgggccgtgtaaatcgctccgccaaaggagcgtttcagatagccttgctgctccaggtaattgagatcattacggatcgttacccctgaaaccgataacatttcagccaaatcgtctacttttatttcgccgtttttacggacgatttcggcaatgtccagacgccttttcaacaggctggtagatggttttgccacaacataccctttttttccgcttcgtcgggaagttatcccgtgctttaactttcatttttaaacttctgacaggggatgtcaattttgcaccacgtcaccgaatgctcaatggaaaacatcacaataaaatcaagtaattatagaattttcatatcttccatttacttacaaaacaaaatttaaatccacactttttctttcatttaagaaaaattatcctgcttttgtgttgatgatcacaatcatgtgtggcaatgatcgttacattactttcaaaacgaaggttatttttattttaaactttaatttcgaaagttataaacggagaccactatgttcattatttccagtaaaaatatgctccagaaggcccagcatgcaggctatgccgtgccagcctttaacatccataacctggaaaccttgcaggtggtggtagaaaccgccgcagaaatgcgctcaccgctgatcgttgccggaacaccaggcacgtttagctatgccggaatgggtaacattgtggcgatcgcgggcgatctggctcgtgaatacaatctgccactggccattcatctggatcatcatgaatcgttagccgatattgaaagcaaagttatggcagggatccgttcagtcatgatcgatggttcccactttccctttgaagagaatgtggcgctggtgaaaagcgtggtcgatttttgccatcgctacgacaccagcgtggaggcagaactgggccgccttggtgggatcgaagatgatttagtggtagacagcaaagatgccctttacaccaatccacagcaagcacgtgagtttgtggcgcgcaccggcattgattcgctggcggttgctatcggcacggcacacggcatgtatgccgctgaacctaaacttgattttgagcgactggcagaaatacgcgctctggtggatatccctctggtattgcatggggcatctggtttgccggaaagcgatattcgccaggccatcagccttggggtatgcaaagtcaatgttgccaccgaactgaaaatcgccttctccgacgccttaaaagagtatttcctacaaaacccgaaagccaatgatccccgccactatatgcaaccagcaaaacaggcgatgaaagaggtggtacgcaaagtaattcatgtttgcggctgtgaagggcaactgtgaggaatcgcctgtgatctacacgctaacacttaatagcgcgattgatatgaatatatttagcgatcctttacagccaaatattgtcaatcgcactcaccacaccgagttttgcccaaatggtaaaggggtaaatgttgcgctggttctggatcactttcaaatacctgcgcatatattaggcatttttggtggtttcaccgggcattatattgtagaaagcctgcgtacccgaaaaatgccagtcacaccagcatgggtagaagaacccacgcggattaatattttcattcatgacggtaagcaggaatataaactggtcaaccctggctcatatattccagatgaatgtaaacaacaaattatcacgattatttcgcaactgcccgatgcagactatctggtgataagcggcagcctgccacaaggtattgaaagccgcttttacgcagaaatcatgcatatttgtcagcaaaaaaatatcggcgtaattttagatattagtcatccgtcattacgtcagttactggagttcaaaccgttattaattaaaccaaatgatgaagaggttaaagcaatattcggtttaactgtctctgacgacaatgatgcgaaaaatactctaaccactttacatgcacttggtgcacaaaatgttctgctaacccttggcgctaaaggaatgtatttctccaatgggattgattactggttttgtagcgcgccaacggttgatttggtgagctccgcctgtgcaggcgatgctgcactggccgcctttctcagccagtggttatctacaggagaagtggaatatgccttatctcttgccagtgcaacaggagctgatgtcgcaagttctgccggactaggccaacttgcggcaatagaaaccttactttcgcaaatccacgtcagaaagctgtaggttaaattacaatataaggtctgcttatgaaaaagatcattgcagtgaccggctgccctaccggtattgcgcatacatttatggctgaagaagccttaaaaaatgccgcgaaaaaattatctgttgaaataaaagttgaaaccaatggtgccagtggcgttgaaaatgctattcaacctgctgatctggtagatattgccggagtcattattgcggcggataaagatgtcttacctgatcgctttaatggtttaccggttattgaagtaccggtaaaagaagcaatccatcatcctgcggagctgattaacaaagttattaatggtgaagccccaatacgtaaaggcgaatcaaccaccagcacggaaattatcgaaaaagaatcactggggcgacaaatttataagcacctgatgagtggtgtttcaaatatgctaccttttgtagttgccggaggcatattaattgcggtgtcgtttttatgggggatttattccgctgatcctaattcagctgaatacaatgcaaccgccgcaatgctaatgaaaatcggtcagcaagccttttcgattatggttccggtctttaccgcttatattgcattctctatttctggcagaccagggatggtggctggatttgtcggcggcttactggcaaatgctaccggcgcaggatttcttggtgggataattgccggattcgccgccggttacctgatgttatgggtaaagaatcgactcgaaggcttaccgcgtcagtatgaaggcctgaaatcgatttttattatgccgctcattggcgtactggttattggcgtgttgatgtcgctgcttgggcaacctgtcgcagctatcaataatagcatgatgaactggctggcatcgctacaggaagcgaatccaatattgctgggtattgtggtgggtgcaatgtgctcctttgactttggcggcccggtaaacaaagccgcttatgtcaccggcacgcttttactgggccaaggcaacttctactttatggctggtgtgtctgccgcatgtattactccaccactggtaattgctctggcgaccaccttctttccaaaaggttttagcgaggaagaacgtgccgcaggcatggttaactatatcctcggttgtacacacatcactgaaggcgcgattcctttcgcagcgaaagatcctttgcgtgtcatcccgatgatgatgattgcttccagcatttccgcagtacttagctacagcttgcgtattcaggttccggctcctcacggcggcttcttaattttacctttggtgagtcagccgctggcctgggtgttatgtatccttgcgggctctgcatgtggtgcggtgatgcttggcctatggagattgtgggctgtgcgcaaaaattcagtcaacacaactcctgtagcaaaggctggaggtcagaatgcagctctgtgaacacgatatttttatcagcgatgagcgcctcgataaagtcaccgctctgcaccgtgtggtggaaaagttatctgcggctggcaataccacgactgactatttacgcggcatgttggatcgcgaagcacagatttccacttatctgggaaatggaatcgcgatcccacacggtacgccagagtctcgcgatgcggtattacaaaccggtgtaaaggtaatcgtttttcgccacggcgttgactggggtgacggcaataccgcgtatctggtcaccggaattgccgcgcgctccaatgaacatcttgagattttgcgccaactgactcgcgtgctcagcgatgacgctattctgcaagcactggctaaagccgaatcccccagtcaggttttagcgctactgactggatcgacgaccaatacgccagcagccgtggagttgcaggagggtgagcaggcaacgtttgtcatccataatccgcatggtttacatgccagacccagtgcggtactggtgaagtttatcaaacagtttcaaagccacattacggtagaaaatctggataacgcctccggcccggtggacgggaaaaacctgatgcgagtggtgtcgctcggcgcgaaaaaggggcatcgcttgttgttccgggcgcagggcgaagatgcacagcaggcactacgtgaaatcggggagcttatcgcctctggtgcaggcgagatgatcaccgttcccgttaccccaccaccagaagtcatgcagccaaagcgcagttggctatctcgattgtttaattagccttcatttgttcctccgtgcccgctccggcgggtacggtttttcatgacaaagtgaagttacagacattacacaccatttcgttaccttacatttcctttcgcaactttcatttatcagatcaaaatcacaaaacaacattacgaaagcctataaattctttcgaagaagaaaaacgaaagaactcggagataaaagtgaaagaaataattgctcgtcataaagcaggagaacatctgggcatctgttcagtttgttctgctcatcccctggttatcgaatcagctctgcttttcgatctcaatactgacaacaaggtattgattgaagccacatccaatcaggtgaatcagtttggcggttataccggaatgaaaccggctgattttcgtgattttgtttatggcattgctcaggaagtgggatttccacgtgagcggttgattcttggtggcgatcatttagggcctaactgctggcagaacgaaccggcagcggcggcaatggaaaagtcggttgagttaataaaagcgtatgtcgccgctggttttagcaaaattcacctggacgcgtcaatgtcctgcgctgacgacccgacaccgttggatccgatggtcgttgcacgccgtgccgccgtgctttgtaaagcagcagaagggaccgcaaacgaagaacaaaaatgccatctgacttatgtcatcggcacggaagtgcccgttcctggcggtgaagccagtaccatcggcagcgttcatgtcacccgcgaagtcgatgctgcacgtacgctggaaactcaccaaatcgcgtttcgtgaatcaggtctggaagaagcactgtcacgcgtgatcgccattgtggtacagccgggcgttgaatttgatcatacccagattattcattatcagccgcaggcggcacaggcgctctccgcatggataaaagaaacgccgatggtctatgaagcgcattcgactgattatcagacgcggcaggcctaccgtgcgctggtacgcgatcattacgccattctgaaggtcggcccggcgctcactttcgcgctgcgcgaagccattttcgcacttgcgcaaatggaaaacgagctgatctccccggaacaacgtagtcgggtactggaggtcattgatgaagttatgctaaacgaaccgggctactggaaaaaatactaccgtccaacctggagccaggcgatggtcgacatccactttagtttgtctgaccgtattcgctattactggccgcacccgcgtattcgtcaaagcgtagagaagttaatcgccaatctgaacaacgtcacattgccgctgggattaattagccagtttatgcccgtacagtttgaacgcctgtctgagggcgtgctcacccctacgccgcataacctgattattgacaaaattcaggatgttctgcgcgcttatcgcttcggttgcacgccggatgtcgcctgaataatggagaatttatgagccaactatttgtccgaaccggaatcacattcgactcgagccaacaggcgctggcgcacattggcaaagagatgctggcgaaaggcgtggtacatgatagttatccgcaggcgctggtggaacgtgaagcgtcttttcctaccggcattgcgctggagcgtcacgccgtcgctatccctcattgcgaggccgttcatgcgaaatcacccgctatctatctgattcgtccagataagccggtcatgtttcaacaggcggatgatgacgaagagattgccgtttcgttaatcatcgccttaatcgttgaaaacccggcggcacagctaaaacttctgcgccgcctgtttagtgagctacagaacccaagcaccctcgatgccctgttaagcgcgccggatgccgaactggcgatacgctttcaggaaaccatccttgagcctgagcagtgcgtccaggtttgataataaattgataataatgaggaataccctatgaaacgtaaagtaattgtggcctgtggcggtgcggttgcaacctcaacgatggctgcggaagaaattaaagagctgtgtgatgccaaccatattgagctcgacttagtgcaatgccgggtcaccgaaatcgaaacctatatggacggcgccgatcttatctgtaccactgccagggtcgatcgcgcctttggcaatattcccgtcgttcacggtatgccttttgtttccggcgtgggtattgaagcattacagcaaaaaattctgtccattctcatggggtaacgtatgtttagcgaaataatgcgttatatcctcgacttaggcccaacggtgatgctgcctctggtgatcatcgtgttctctaaactgctgggaatgaagcttggggattgttttaaatcgggtttgcatattggtatcggcttcgtgggtattggtctggtcatcggcctgatgctggattctatcggccccgcggcgaaagccatggcggaacatttccaaatcaatctccacgttattgacgtcggctggccgggttcatcgcccatgacctgggcgtcacaaatcgcgctggtcgcgatccctgtcgccatcggggttaacgtcctgatgctagtgacccgcatgacccgcgtggtgaatgtcgatatctggaatatctggcacatgaccttcacgggcgccatgctgcatctggcgaccggttcatactggctggggattctgggcgttgtggttcatgccgcctttgtctacaaactgggggactggtttgccaaagatacccgcgactattttggcctcgaggggattgctatcccacacggctcatccgcgtacctgggccccgtggcggtgctcgttgataccattatcgagaaaattccgggtctcaatcgtattcactttagcgcagacgatgtccagaaacgcttcggaccgtttggcgagccggtgactgtcggcttcgtgatggggctggtgattggtgtactggcaggctacgacgccaaagccgttctgcaactggcggtcaaaaccgcagcggtgatgctgcttatgccacgcgtcattaaacctattatggatggcctaacgcctatcgcgaaacatgcgcgtaaacgtctacaggctaaatttggcgggcaggagttcctgataggccttgatccagcgctactgctcggtcatacctctgttgtctccgcgagcctgatattcattccgctgaccatcctgattgccgtcttagtaccggggaaccaggtgctgccgttcggcgacctcgccaccatcggtttctttattgcgatggcggtcgcggtacaccagggcaacctgttccgcacgctgatttcaggtgtcattattatgggtatcaccctgtggatagccacccagacgattggcctgcatacccaactggctgccaatgccggagcgctaaaagctggcggacaagtcgcctcgctggatcagggcggttcccccatcacctggctgctgattcaactttttacctggcagaatatcgtcggcttcgccgtcattgccattatctatctggccggcgtactgctgacctggcgtcgcgcccgacagtttgtcgcggctgagaaagccacggcgctacagcaaagtcaaatcgcctcttaattttaggggagcaatcgctcccctcaccttcctggagaatgttatgaaatcagtggttattcacgctgagggagacgtgcgcgttgaagaacgtcccttaccacaactgcaagccgaggacgatgtgttggtcaaggtcgttagctcagggctttgcgggtcggatatcccgcgtattttcgcgcagggcgcccattattatcctattacgttaggtcatgaattcagcggctacgttgaatcctacggcacaggcgtaacggatatgcagcccggcgatgccgtcgcttgtgtcccgcttcttccctgctttcactgtccgcaatgcgaacgcggttacttttctttatgcaaacagtatcagtttgtaggatcgcgcagcgaaggcggtaatgcggaatatgtggtggtcaaacgggccaatcttttccgcttgccttctgatatgccgattgaagatggcgcgtttatcgaaccgattaccgtgggcttacacgcctttcatctggcgcagggctgcgaggggaaaaacgtaattatcgtcggtgccgggacaattggcctgctggccttacagtgcgcgcgggaactgggcgcgcgaagcgtaacggcgattgatatcaatccgcagaaactggaactggcgaaagcgctcggcgcaacgcatacctgtaatagccgggaaatgaccgccgacgacatccagaccgcgttgtccgacattcagtttgatcaactggttctcgaaacggcaggaactccccagaccgtctcgctggctatcgatatcgccgggccgcgcgcgcaactggcgctggtggggacgttacatcacgatctcaccctgacaacgcgtacattcgggctaattttgcgtaaagagctcacgctcctcggcagttggatgaactactccgcgccatggccaggagaagaatgggaaaccgcagcgcgcctgttggctgaaaaacgtcttcaactgacccctctcattgcccatcgcggcgatgcggaaagctttgcagaagcagtcaaagcgcttaatggcgcgcccatgcagggcaaaattttacttcaactttcctgatggtacgagccagcaacctgcgctggctcacatttcctttcgaaatttagcgttcacctttcgcaatccttcgtttaaactagttacagttaattatcaggcaaatcaatatgaactcatttgagcgaagaaataaaattgtcgacctgattaatacgcaaggcagcgtgctggtgatggacctttcaaatacctttggtatttctgaagtgactatccgtgctgacctgcgtctgctggaagagaaaggccttgtcacccgttttcatggcggcgcggcaaaaccgggaagtcatctggcggaaggcgacaatcaggaagtcattctggaagatcggtatcaactcgccagcgatccgaaaaagcggattgcccaggcggctgcggcaatggttgaagaaggaatgaccatcattctggatagcgggagcacaacattactgattgcggaagcgctcgcgcgaaaaagcaatattacggtgatcactaacagcttgcctgccgcttttacgctatcagaaaataaagatctcacgctggtggtctgcggcggtacggtacggcataaaacccactcaatgcacggcacgattgcggaacgatcgctacacggcatcagcgccgatttaatgtttgtcggggcggatggcattgatgcgacaaacggtattaccacgtttaacgaaggttattccattagcggcgtcatggcggcggcggcacacaaagttatcgcggtactggacgcgaccaaatttaaccgtcgcggctttaaccaggtattgccgatggacaagatcgactgtgtgataaccgatgacaccatcagcaaacaggataaagcggcattagcgaaaacaggcgtggaattaatgatcgtctaaaaaggagtcggttatgcgttgctgatcgcgagagtaagcccgaaggaaaggtccggcccgctatcaccgcccaatgcccccatcaatttacccacatcaatcacctgattgagtattaacacgatggcgataaaaggcggttcccgggcgctcgcttttattcttcctgctgctccagcgcatacttatacagcgcatttttcttcacgccgtgaatttctgctgccagcgccgccgcttttttcagcggcagttctgcctgtagcagcgccagcgtgcgcagcgcgtcggcgggcaggtcgtcttcttgcgctttatggccttcgacaatcagcaccatttcgcctttgcgacggttttcatcttctttgacccacgccagcagctcgccgaccggcgcgccgtgaatggtttcccaggttttggtcagctcacgcgccagcaccacataacgggattctcccaataccgcgacgatatcttccaggctatctaacaggcggtgggttgactcataaaaaatcagcgttcgcggttccgtttcaatggcttttagcgcatcacggcggcctttggatttcgccggtaaaaagccttcatagcagaaacggtcggatggcaggccagcggcgctcagggcggcaatcgccgcacacggccccggtagcggcaccacgcgaatccccgcttcgcgacaagtacgcaccaggtggtagcccggatcgttaatcagcggcgtaccggcgtcggaaaccagcgcaatgttctgcccttcttttagcttcgcgaccagcgtttccgctttttgttgttcgttatggtcgtgcagcgcgaacaaccgggcattaatcccaaaatgttgcagcaataaaccggtgtgacgagtatcttcggcggcaatcagatctacagcctgtaacacctccaacgcacgctgggtaatatccgccagattaccgataggagtaggtacaataaagagttggccctgagaattatccgccgattcgttttgtttcattgtgtcgtccgtattgccgatttaatattgagcattgcgtaaaaaaatatcactggatacagtatggtaccctcaacattttctcgtttgaacgccgcacgcgcgctgcctgtcgtcctggctgcgctacttttcgccgggtgcggcacccaggcgccagatcaaagcgcagcctatatgcagggttcagcgcaagctgactccgccttttacctgcatcagatgcagcaaagcgcagatgatagcaagaccaactggcaattactcgccattcatgcactgctgaaagaaggaaaaagccagcaggccgtcgacctgttcaaccaactcccgcaaaatctgaacgatacccagcgtcgcgaacagtctttattagcggtagaaatcaaactggcgcaaaaagatgtcgcaggcgcgcaggccttgctggataaactaaaacccgccgactttgcgccaaatcaacaagcgcgttactggcaggcgcagatcgttgccagccagggacgcccgtcgcttaccctgttgcgggcgttaatcgcccaggaaccgctactggcggcgaaagataaacaaaaaaatatcgacgccacctggcaggcgctctccgccatgacgccggatcaggccaggacgttagttatcaacgctgatgaaaatgtgcttcagggctggctggatctgcaacgcgtctggtttgacaaccgcaacgatccagacatgctgaaagctgggatcgccgactggcaaaaacgctacccgcaaaatccgggggcgaaaatgctgccgacgcagctcgtcaatgtacaacgtttcaaaccggcttccaccagcaaaatcgctctgctgctgccgctgaacggtcaggctgccgtgtttggccgtaccatccagcaaggtttcgaagccgcgaaaaacctcggcacccaggcggtggagatgcagcctgccgccgctcctgacgcgccggtcgaacctggcgtggaggagacgcaaccacaaatgaccaacggcgtcgccagtccgtcgcaggcctcggtgagcgatctgactgatgacgctccagcccagtccgctacgccagtcagcgcgccacaaactccccctgctacagcaagcgcgccggcggatccctccgctgaattaaaaatctacgatacctcttcccagccgttggatcaggtgcttgctcaggttcagcaagacggcgccagtatcgtggtcgggccgctgttgaaaaacaatgtggaagcgctgatgaaaagcaacacgccgctcaacgtgctggcgctcaaccagccggaaacggtacgtagcttccctaatatctgctatttcgcgctctctccagaagatgaagcccgtgacgcggcgcatcatatttatgaccagggcaagcagtcgccgctgctgttgattccacgcagcgcgcttggcgatcgcgtggcgaacgccttcacccaggagtggcaaaaactgggcggcggcatcgtgttacagcaaaaattcggctccgtagccgagctgaaaatgggcgtgaacggcggcgcgggtatcgcgttgactggcagtccagtcgccgccagcgtgcctgcgcagcctggcgtcaccattggcggtctgaccatccctgcgccgccgaccgacgcgcaaatcaccggcggcggacgcgtagacgcggtctatattctggctacgccggaagagattggctttatcaaaccgatgatcgccatgcgtaacggcacccagagcggcgcgacgctgtatgccagctctcgcagcgcgcaaggcacctccggccccgacttccgtctggaaatggagggtttacaatacagtgaaattcctatgctggcaggcggcaatatgccgttgatgcagcaggcgctgagcgctgtacataacgactattctctggcgcggatgtacgccatgggcgtggatgcctggacgctggcgaaccacttttcgcagatgcgtcaggtgcaggggtttgagatcaatggcaataccggcgcattaaccgccagcccggattgtgtgattaacaggaagttatcatggctcaaataccagcaaggggagattgttcccgccagctaacgcgtaaacaggctggcgacgcgtgggaagctgccgcgcgtcgctggctggaaagcaaaggactgcggtttatcgccgccaacgtgcgcgagcgcggcggcgaaatcgatctgatcatgcgcgacggaaaaacgacggtttttgttgaggtccgctatcggcgctccgggctttatggcggcgcggcggctagtgtgacccgcagcaagcaacacaaattattacatactgcccgcttgtggctcgcccgccagaatgggagttttgatactgtggattgtcggttcgatgtgttagccttcaccggaaatgagattgagtggtttcgggatgcgtttaacgaccactcataattgaagattttaaggattagcgtgctcgaaagaatcaaagtttgctttacagaaagcattcaaactcaaattgctgcggcggaagcgcttccggatgccatttcccgcgccgccatgacgctggttcattccctgcttaacggcaacaaaatcctctgttgtggaaacgggacgtccgcggccaacgcacagcattttgctgccagcatgattaaccgctttgaaacggagcgacccagtttacccgccattgcactaaataccgataatgtggtcttaactgcgatcgctaacgatcgcttgcacgatgaagtttatgcaaaacaagtccgggcgctgggacatgcaggcgatgttttattggcgatctctacgcgtggtaatagtcgcgatatcgtaaaagccgttgaagcagccgtcacacgtgacatgaccattgtggcgctaaccgggtatgacgggggtgagctggccggactattagggccgcaggatgtcgaaattcgtatcccttcacaccacagcgcgcgcattcaggaaatgcatatgctgacggtaaactgcctgtgcgatttgatcgataacacgctttttcctcaccaggatgattaaggagtacacatgaaggcattttcgccgctcgcagtccttatttctgcgttgctattgcaaggttgcgtcgccgccgcggtagtgggtacggcagccgtcggtaccaaagccgcaaccgacccgcgtagcgtgggcacccaggtggatgacggaacgctggaactgcgtgtcagcagcgcgctgtcgaaagatgagcaaatcaaaaaagagacgcgcatcaatgtcacggcttatcagggcaaagttttgttagtgggccagtcgccaaacagcgaactctccgcacgcgctaaacagatagcgatgggcgttgaaggcaccaccgaggtctataacgagattcgccagggtcagcctatcggcctggggaccgcctctaacgatacctggatcaccacgaaagttcgctcacagctactgaccagcgatcaggtaaaatcgtcaaacgtgaaagtcaccaccgagaatggcgaagtgttcctgctgggcctggtgactgaacgtgaaggtaaagcggcagcagacatcgccagccgggtgagcggcgtgaaacgcgtgaccaccgcctttacgtatattaagtaaccggtgtgccgggtggcgataagaatgtgtaaaccgcgtcgccatccggtaaatcatccggcttcgctactccgctttttcccgcagttgcgatgaggtcagaatcgtcacgccttcttgtgctggcgccagcgcttccgccagcatggcccgcgccacatcccgcgcatcgatcgatttccagtttcctggcaacagccggaatagcggagcgaaaagcgtttcattcacccgccgcgttgttctgtcgccgagcagcatagaaggtcgggcaatcgtcaaacgaggccaattttgcgcgattaacgcctcctccatttctcctttcacccgattgtagaaaaacggagagtgcgcgtttgctcccattgcgctgaccaccaccatgtgctgcgcacccagtcgacgtccggtcagcgcagtatcaaccaccagcgtataatccgcatgaataaacgccgctttacttcccgcttcacgccgggtcgtgcccaggcagcaaaaaacaatatctaccgggtcggtcacctgagctaacgcatcggtaagctgcggatcgtgagggttataaacgccgacaatatccgtcagcgggcgacgcgtcggcgcggcgatagcgctcacctgcggcgtgttgattaacattctcagcagatgtccgccgaccagtccggtcgcgccggtaatcagtacctgactcatcctcgctcctttacagatttgtccaccttgcactctcggccctatcgaccaggcttaatagtctacgaggtaagtatccatcattgtggaaaatttgccttacccgacgccaccactgcggaggaaacgcatgagtaagaaaattgccgttttgattaccgatgaatttgaagattcagaatttacctcgccggcagcagaattccgtcaggccggccatgaggtcatcaccatcgaaaaagaggcgggtaaaacggtgaaaggaaaaaaaggcgaggccagcgtcaccattgataaggctattgatgacgttcgtcccgacgagttcgacgccttgctattgccgggaggtcattcgccggactacctgcgcggcgacagccgtttcgtggattttacccgcgatttcgttaacagcggtaaaccggtttttgccatttgccacggcccgcagttgttgatcagcgccgatgtcattcgtggccgcaaactcacggcggtgaaaccgattattatcgatgtgaagaacgcgggcgcggaattttacgatcaggaagtcgtcgtcgataaagatcagctggtgaccagccgcacgcctgacgacctgccggcatttaaccgcgaggcgctacgcctgctgggcgcgtgagtcacgtaaccagtgcagttttttaccaaaccccagcgtgttgtcggtgaatttaatttcatccagccggatttcccataccggcgctggcagcaccctggcgaccgggaagcgacgaaggtaagctttacgcgcggcgtcgctctcctgcccctccagacggcgaatttcccctttaaactgcacgccgcgaatgcgcgccaccgttttcggctgcccattgaccgttcccgcaactggcgcgcacgcgccggacatttgcgcatggcgggttttatcatccgttaacagatacagtgcgacgttttgcgcatcgaacaaataaaacgcattggcgcaccacagctctccctcatggtgtacgcaccaggtcaccacgtgttgtttcgccagccaacggccaatagcggtaagtgtgtccatctttattctcgcttatactgggaacctgaaaattatcatgctgatggcgacaatgaccccctggtatctgtatctgattcgtactgcagacaatgcgctttacaccggaataaccaccgatgtggcgcgtcgttacaggcagcatcaaacgggaaaaggcgcaaaagcattacggggaaaaggcgagttaacgctggcgtttgcggcgcaggtcggcgatcgctcgctggccctgcgcatagagtatcgcatcaaacagctcacaaagcgccagaaagagcgccttgtgacggaacgcgaagcgtttgaggcgctgctgtccagcctgcaaacgccggtgcttaaaaacgattgaagtggtcgtgatactccaccagccccgtcacgccctccagcgcatcctcagccaaacggtgtacctggaaagcgctttccgtaccgggccaacggcagtgaagatcgtaatgtgcggccagttcaaaaccgaagcggctatataacgccggatcgcccagcgtcacgaccgccgcgtagccgaactcgttgagcgaatccagcccttcatacactaactggcgcgccagcccttgcccgcgatacttttcatcgaccgccagcggcgccatgccgacccactgtaaatcttcgccctgcacatcaaccgggctaaaggcgacatagcccaccacctgaccttcatcatccgtggccaccagtccgagcgtcagaaaaccatcttcacgcaaatcgtgaaccagcttcgcttccgcatcgctttcgaatgaacggcgtaacagcgcatcaataccaggcgcatcaataggaatttctactcgaattagcatggttcacctaccgaggtctgtttggtttccggcgagtttttcattcccgcctcaacaaaatccgccagttgcagcagcataacgcgtaacgctttcggcatctgctccagttcgatggcgtccatcagattcttcacatacaaccctaactcagtatcgccttcaatgaccagtcgacgctggaaaaagagcgtatccggatcctgtttacgggcggcgatcattagcagatcgctggcgtcggcgctaaaactgacgtcagcatccgcctgctggctaacgatcagcttttcattttcaaccgtggtataccattttaagtcgatgtcacgaacatgaatgcttaaccaacgaccttcgaggaattccagctctccatcggccagcgcctgacgaaactgccagctcagaacctgttccagaacctggcgctttagcgcaaagggcgtcagtttaaccggtacactcatcagagacgggccagcatggactaagcgtgaacgcagtttatctaacacgagctttactccctgtttcaatagtcctgttattttgccatatccaataaatcacatggcggcgtaaatcaacaattgggtctgattttctaccccattattggtgttaccaatacgcctttaactgccttaaatcaaaaattgtcgcagcaaggttaactaaaatccctgttcgttaacaattttgcgtctcagacgtaaccctcaggataaattatggagctgctctgccctgccggaaatctcccggcgctgaaggcggccatcgaaaacggcgctgacgccgtttatatcgggttaaaagacgataccaatgcccgtcattttgccggccttaactttaccgaaaaaaaattgcaggaagcggtgagttttgttcaccagcatcgccgcaaattacacatcgccattaatacttttgcgcatccggacggctatgcccgctggcagcgcgccgtggatatggcggcgcagcttggcgccgacgcgttgattctcgccgacctcgctatgctggaatatgccgcagagcgttacccgcatattgagcgccatgtttccgttcaggcctcggcaaccaacgaagaggcgattcgcttttatcaccgcaactttgatgtccaccgtgtagtactgccgcgtgtactgtcgattcaccaggtaaaacaactagcccgcgtcacgccggtgccgctggaggtattcgcgtttggcagcctgtgcattatggcggaaggtcgctgctatctttcttcctacctgacgggggagtcgcccaataccgtcggcgcctgctcgcccgcccgctttgtccgttggcagcaaacgccgcaggggctggaatcgcgcctgaatgatgtcctgattgaccgttaccaggatggcgaaaacgcgggctacccaacgctgtgcaaaggccgctatttagtggacggcgagcgctatcacgcgctggaggagccaaccagcctgaacacgctggaactgctgccggagctcatggcggcgaacatcgcttcggtgaagatcgaaggccgccagcgcagcccggcctatgtcagccaggtggcgaaagtgtggcgccaggcgatcgatcgctgcaaagccgccccgcaaaacttcgttccacagcgcgactggatggagacgctcggcgcgatgtccgaaggcacccaaaccacgcttggcgcatatcaccgtaaatggcagtgagaggagctatgaaatattccttaggaccggtgctttattactggccgaaagagacgctggaagatttttatcagcaggccgcaaaaagcagcgctgatgtcatttatctgggcgaagcggtgtgcagcaagcgtcgcgcgaccaaagtcggcgactggctggaaatggcgaaatccctcgccgccagcggtaagcaggtggtgctctccaccctggcgctggtacaggcgtcatctgaattaagcgagctgaaacgctatgtggacaacggcgattttctgctggaagccagcgatcttggcgtggtgaatctgtgcgccgagcgcaaactgccgtttgtcgccggccatgcgctgaactgctacaacgcggtcacgctgcgccggttgctgaaagaaggcatggtacgctggtgtatgccggtggagctgtcccgcgactggctggtgaatttgcttaatcagtgcgatgaactgggcatccgcaatcagtttgaagtggaagtgttgagctacgggcatctgccgctggcctactccgctcgctgctttaccgcccgttcggaagaccgcccgaaagatgagtgcgaaacctgctgtatcaagtatccaaacggtcgtgacgtgctctcgcaagagaatcagcaggtgtttgtgcttaacggtattcagaccatgagcggctatgtctataaccttggcaacgaactgacgtcgatgcagggattggtcgatatcgtgcggctgtcgccgttggggacggagacatttgccatgcttgatgcctttcgcgctaacgaaaacggcggcgcgccattaccgcttgccgcgcatagcgactgtaacggctactggaagcggctggcaggtctggagctacaggcctagccggatggcggcataaataccttgtccggcctacaaatagcgatcccgtaggcccgataagcgcagcgccatcgggcattgtttttgccgtcagtctcataaagctcactttgttaacaacattcgctaatctttaatgcagtattaaaagattaaccggtaacaaagtgagccgttatgactgacaaaactattccgttctcggtgctggatctggcgccgatccctgaaggatcttcggcaaaagaagccttcacgcactcgctggatctcgcacggctggctgaaaagcgcggttatcaccgctactggctggcagaacatcacaacatgaccggtatcgccagcgcggcgacctcggtattgattggttatctggcagccaataccacaacattacatcttggctccggcggcgtgatgctgcctaaccattcaccgctggtgattgccgagcagttcggcacgctgaatacgctctacccgggacgtatcgacttagggttgggacgcgcgccgggtagcgatcagtcgacgatgcgcgcgctgcgtcgccatatgagcggcgatatcgataactttccacgcgatgtcgcagagctggtggactggttcgacgctcgcgaccctaatccgcatgtgcgcccggtgcccggctacggcgagcagatcccggtctggctgttgggatccagcctgtatagtgcgcaactggcggcccagcttggcctgccgttcgcctttgcttcgcatttcgcgccggatatgttgttccaggcgctgcatctgtaccgtacccagttcaaaccttcagcgcggctggaaaaaccgtacgcgatggtgtgtatcaatattatcgccgccgacagcaaccgcgacgccgaattcctgtttacctccatgcagcaggctttcgtgaagctacgccgtggggaaaccggccaactgccgccgccgattgagaatatggagaccttccggtcgccatccgagcagtatggcgtgcagcaggcgctgagtatgtcgctggtcggtgataaagcgaaagtccgccacgggctggaatccatcctgcgggagacccaggcggatgaaattatggtaaacgggcagattttcgaccaccaggcacgcctgcattcgtttgatttagcgatggatgttaaggaagagttgttgggctgattttataacgccgattttcaacggtgatggttggcaatcggcgatttttttcgaagtaatcatagccgggcttcaacatacgccagaaattatattccggccatgcttgcgcctggcgcatattttcgtcattcatcgtaaatgggaagatatggacaggcacgctcttctgcccgctgtttagcgcctgcgccaccagttgataaatctcttcaataccggcatcggtcatggcatagcaaccggccgaaacgcagttcccgtgaaccataatgaaatcaccggtgtagccatttgcccgatcgtaagcattcgggtagccaatattaaatgccagatgatagcggctgtttgggttaagcaaccctttgttggtggcataaaagccttccgggcttttaccgtctccctgtttatgttttggccctaagccaccagaccatgcgcatatagtccaggttttgtagagtttgtaaggcttgttattggcgcttgcccacagttccagcttatcttccgctttcagaatgcggataaataactggtcgccggggtgaatgatttttaaagacgatgcgacaggtttttccactggcaggtaaacgtcttcatcgtacggagtgagccagaaaaattttaaaataaaagcgataaacaggctcaataatacaatagcgagtagtcctttacgccccattttcgtattccgcttattctgaaccagttcaagtatatattttcctatgatatgaaatagaggaaaggtccagttctgtacttttataaaatagtaatcgttttatcatggccgaacagggatatgaataaatcgacttattaccagagaaaatcatcatgagtgaacctgcttccttttttcttcatgcacatattaccgagagtaacctcaagaaatttttccattcaccggcaacaaatattaaagactatgacgactggttgccatggtttactgaggagcaaaggttgtacggcgatcctgcaaaaatgcttaacaatcttgccacatgtaattctggtgaaagtgaaaagaatatttatgctgaacatatcaactttaataaagaaacacagatagtcacgatggatcacatatttctctcagagagctatgaaatcttcatgccactcatggcctgtgtgcggggaatcgagaaatttattacgccaggggaaaataattttgcgctaatttattattactggtggggttcggagatcgccatcgcgctcgaatttgacgccaatggtagcagaataacggcaaatcctaaggcagaaaatttaactatcgccgatgcttttttcgatgaacacggggaagcactcgccgaagaactttataataaacagggttttatttgataccatttcgcggacttgtgaaatattgccggatgaaaacagctcatccggctcgttcaattactggtacaccggcaacaaattaaagctcgataaaatatgcaccagtgcgttcccgacgccaaatagcagaatcagtacaatcatcggtttaccgccccagacgcggaatttcgggctgccgaaacgttcgcgagatttacgtgccaacagcgcaggcacaatggccgcccagatagttgcagctaaacctgcatagccaatggcgtacagaaaaccgttcgggtacagcaggccaccaatcatcggcggcaggaaagtcagcagcgccgttttaaaacgtcccattgccgagtcatcaaaaccaaacagatccgccagatagtcaaacagccccagcgtcacgccaaggaaggaactggcgaccgcaaagttagagaacaccaccagcagcagatccaggctgcggctgttcagcacgccgctcaacgcctgtaccagcacatcaatattgccgcctttctgcgcaatgccgataaattccggacgcgggatgttgcccatcgtccccagcagccagacggaatagagcgctagtgccagtaacgtcccataaatcaggcatttgacgatggtacgcggatctttgccgtaatatttcatcaagctcggtacgttaccgtgataaccaaaagaggccagacaaaatggcagcgtcatcagcaggtacggcgtatatgacgcgtggctttcagccacgttaaacaacgtggcaggctgaacgtgccccaacaggctgccgaaggtcaggaagaaagtaatcactttcgcgcccagcacaatcgccgtcatccggctgaccgccttcgtactcagccacacgacaaacgccaccagcagcgcaaaggcaaaacctgccgctcgcgccggaacgttcagcgacatctcagcaaaggtatgatgcagaattgagccgctcgccgagatataggcgtaagtcaggatgtagagcacaaaggcaatagaaatgccgttgaccacgttccagcctttccccaacagatctttggtgatggtgtcgaaactcgaaccaatgcggtagttaaggttggcttcgagaatcatcagcccggagtgcagcatacaaaaccaggtaaagaccagcgccgccatcgaccagaagaaccacgccccggacatgaccaccggcagggagaacatccccgcgccaatgatggtgccgccgataatcaccacgccgccaagcagcgaaggtgacgtttgggtggtggtaagtgttgccattcagctctctctccagtcatttatagtgtgactatctctcaatacgctgcactgtaccagtacacgagtacaaaagaaataaaaaaagccccgattgtgacgatcggggctgtatattttactttacgctgtgaatgcgcaggtcagcgtgagttacgcatcaccgccgaaacgacggcgaccggtagagtcatcacgacgcggaccacggctttcacgacgttcgccgctgaagcgacgaccatcaccacgaccaccttcacgacgttcgccgctgaaattacgaccgccttcacgacgttcgccactgaagctacgaccaccgccgcgacgttcgccgcccgcgtgcggaaccgcatcacccaacagctgcatattcatcggcttgttcagaatgcgggtacgcgtgaagtgctggagcacttcgcccggcatacctttcggcagctcgatggtggagtgagacgcgaacagcttaatgttgccaatgtaacggctgctgatgtcgccttcgttagcgatagcgcccacgatatgacgaacttcaacgccgtcatcacggcccacttcaatgcggtataactgcatatcgccaacgtcacgacgttcacgacgcggacgttcttcacgatcgccacgcgggccacggtcattacgatcgcgcggaccacggtcgtcacggtcacggaattcacgcttaggacgcatcggcgcatccggcggcaggatcagcggacgctcgccctgcgccattttcagcagtgcggcggccagcgtttcgagatccagctcttcaccttcggcagacggctggattttcgccagcagcgcacggtactgatccagatcgctgctttccagttgctgctgaactttcgcggcgaatttttccagacggcgtttacccagcagttctgcgttcggcagttccacttccggaatggtcagcttcatggtgcgttcgatgttgcgcagcagacgacgctcgcggttctcaacgaacagcagcgcgcgaccggcgcgacccgcacggccggtacgaccgatacggtgaacgtaggactcggagtccatcggaatatcgtagttcaccaccaggctgatacgttcaacgtccagaccacgtgccgcaacgtcggtagcgatcaggatgtccagacgaccatctttcaggcgttccagagtctgctcacgcagcgcctggttcatatcgccattcaacgcggcgctgttgtagccgctacgttccagcgcttctgctacttccagggtcgcgtttttggtacgcacgaagataatcgccgcatcaaagtcttccgcttccaggaaacgcaccagcgcttcgtttttacgcatgccccagacagtccagtagctctggctgatgtcaggacgggtagtcacgctggactgaatgcgcacttcctgcggctctttcataaagcggcgggtaatgcgacgaatcgcttccggcatggtggcggagaacagagcggtctgatgaccttccgggatctgcgccataatagtttcaacgtcttcgatgaagcccatacgcagcatttcgtcggcttcatccagcaccagaccactcagtttagagaggtcgagggtgccgcgttttaagtgatcaagcagacgtcccggcgtaccgacaacgatctgcggcccctgacgcagggcgcgtaactgcacgtcataacgctgaccgccgtacaaggcaaccacgtttacgccgcgcatgtgtttagagaaatccgtcatggcttcggcaacctgtaccgccagttcgcgggttggcgccagcaccagaatctgaggtgccttcagctcaggatcaagattgttgagcagcggtaaagagaacgctgcggttttgccgctaccggtctgggccatgcccagcacgtcgcgaccgcccagcagatgcggaatgcactctgcctggattggagatggtttttcgtaacccagatcggtaagggcttcaaggataggagccttcagccccagatctgcaaaagtggtttcgaattcagccatgtagtacgtgtgcctcaaaattaatggcggccagtctacataactcatcatgaaattgatctgcaattttcattgaaaagtgtgaaccggctcaaagtaggtgtattaacgaacaacaacgccctcacccgcgaaggtgatggcaatcaaaaagattacgggctgatatgttcgtcagctattgctggtccgattctgccaggtcatcttggtcctggcccaggagcgataattccaacaatgcgtatcggtgctcaacaaagttatgaacgttgttggccaccgccagtttgaacagagccgtggcgctgtccaaatcccccagacttaggtaatacttacctaaatagaagttggtttcactgagatgctcagcgagcgaggtgttatccgttgcgtccgccttgagcctttccatcagcgttgcttcgctaatgtcgcccaggtagaactcgacaatgttccatccccattgctctttatccgatttttcgaagcgtgcttttaacgcttctttcgcctgcttctcattaagcttctgctcaacaagatacagccacaggctgcggtaaggatcattgggatcgtcttgataaaacgccagcagatcatcttgcgctaacttatcacggccgccgtaatacaatgcgataccgcggtttaagtgcgcgtagttgtaagttggatcaagctctagtacagaatcaaacgcttcataggcagcatcaaaattgcctgcctgcgttaaataaatgcctaagtaattgaatacttcaggcatatccggtctgattgccagcgcttgtgaaaaatcatttcgcgctaatgccctcaaaccaagactatcatacaacactccgcgctcatataaaagctgtgcgcgttcgtcatcggttaaagcccgactggcaagaatctgttccatacgcgccagaatcacttcctgctgtaaagtcggttgcaatggtactgcgaggacttcacttttacgccaggcggaattactgcatcctgcaagcgtaagtgctgtcgcaacgaaacaccagcgcaaaaaaggcttcatttcccactcccgaagacaacgattgaatgaacgtcctgttccccggtggctcaacaaggcgtccagccaggtctaaagccctccgcactgcggagggcaaaaggctaccttactcggcctgttcgctcgccggagcttccggcgcagccgcaggttgagactgctcggttgcttctttaatgctcagacgtacacggccctggcggtcaacttccagaaccttaaccgggacttcctgacccatctgcagatagtcggtcactttctctacacgtttatccgcgatttgagagatgtgaaccagaccttctttcccgccgccgatggcaacaaacgcgccaaagtcaacgatacgggtcactttaccattgtagatacggccgacttcgatctctgcggtgatctcttcgatacgacggatagcgtatttcgctttttcaccgtcggtcgccgcgatcttcacagtaccgtcatcttcgatttcgatggtggtgccggtctcttcagtcagcgcgcggatcacagaaccgcctttaccgatcacgtctttgatcttgtccgtgctgatcttgatggtatggatacgcggcgcaaattcagagatatcgccgcgcggcgcgttgatcgcctgttccatcacgcccaggatgtgcagacgcgcacctttagcctggttcaacgcaacctgcatgatctctttggtgataccttcaattttgatatccatctgcagcgcagagataccgtcgcgggaacccgccactttgaagtccatatcgcccaggtgatcttcgtcgcccagaatgtcagacagtacaacgtagttgtcgccttctttcaccagacccatagcgatacctgctacggcggctttaattggcacgccagcgtccatcagcgccagagaagcgccgcacacggaagccatagaagaagaaccgttggattcggtgatttcagacaccacgcgaacggtgtacgggaatttatccatgtccggcatcactgccagcacgccgcgcttcgccagacgaccgtgaccaatttcacgacgcttcggagaaccgaccatgccggtttcgcctacggagtacggagggaagttgtagtggaacaggaagctgtcagtacgctcgcccatcagttcatcaagcacctgcgcgtcacgggcagtacccagagttgcggtaaccagcgcctgcgtttcaccacgggtaaacagagcggaaccgtgagtacgcggcagtacgccagtgcgcacgtccagaccacggatcatgtctttttcacggccatcaatacgcggctcgcctgccagtacgcggctacgcaccacgtttttctcgatagcgtgcaggatttcgcccagctcgttagcatccagagtttcatcttctgcaataagctgctcgatggtttcggatttgattacgtcaacctgagcatagcgctcttgtttatcggtgatgcggtacgcgtcgctcagacgagattcagccagcgcagcaacacgcgcgttcaacgcgtcgttgacggcttccggctgccagtcccaacgcggtttaccggcttctttcaccagatcgttgatcgcctggataacaacctgctgctgctcgtgaccgaataccaccgcgcccagcatagtgtcttcgctcagcagttcagcttcggattccaccatcagcacagccgcttcggtaccggcaaccaccaggtccagcttgctttctttcagctcgtcctgggtcgggttcagcacgtactggtcattgatgtaacctacgcgcgccgcgccgattgggccgttgaacggaatgccggacagcgacagcgcagcggatgcgccgatcatcgccacgatatccgggttaacctgcgggttaacggaaacgacggtcgcgataacctgcacttcgttaacgaagccttccgggaacagcggacgaaccgggcggtcaatcagacgcgcgatcagggtttcgccttcgcttggacggccttcacgacggaagaagctgcccgggatacgaccagcagcgtaggtacgctcctgatagttaacggtcagtgggaagaagtcctggcctggcttggcttttttctggccgacaacggtaacgaatacggcggtgtcatccatgcttaccataacagcggcagtggcctgacgcgccatcatgccagtttccagcgtaacggtatgctgaccgtactggaatttacgaacgatcggattaagcaaaataatatcctttccaatttttgacggcataatacgcgccgtcgttaatacccgatcttctgcgcatcctcgcgactaatgacaaccctaaccctgatatgggtaaagcctctcattagccgcgcgaacctctgcaacggaagatcattcatagcaacaatacattagtttccagcgaattgctgccatctgctggaaaaaaggggccatgaaggccccctctttctgaaactcgaaagaattagcgacgcagacccagacgctcaatcagcgcggtgtagcgtgcaacatctttacgtttcaggtagtcgagcagtttacgacgctgagaaaccatacgcagcagaccacgacggctgtggtgatcttttttatgctctgcaaagtgaccctgcaggtggttaatctgtgcagtcaacagagcaacctgaacatcggtagaaccggtgtcgtttgcgtcacgaccgaactcagaaacgattttagctgtagcttcagtacttagagacattttaaaactccaaagtatttaagaatgagaggacgccgatctctaattcagcgatcccagtgtacgccgcgtaaactgttaaataatttacgcgacgttaagcggcggtattctactcgcagcgctctcttatcgcaagacgaagcgacattacgctgggtactctactaccagccgacgaggcgcgacacggccttcgtcgtcaatttcgcccataccgataaatttatcgtcttcaccttccgtcacacgaaccagtcccttcaacggcgcgcccgtggtacgaaccgggttgccatttttgaagtataccgaagatgttaacggcagattaacaacaggatagtccgaagctggactgtccattggcatcaataatggatcgagcaactgcgccgccggaacgccctgctgttccgcctgtgctaccagcgtctgcaaatgctccagcgtcaccatacgatccaccggatacttgctgaccgtcagacgacgcaggtacgttacgtgcgcgccacagcccagtttctcacctaaatcatcaataatggtacgaatataggtgcctttggagcaatgaacttccagctccagctcgttaccttcatggcgaataaacagcagctcatagacggtaatcgggcgggcttcgcgcggcacttcgataccctggcgggcatattcgtacagtttcttaccctgatacttcagcgccgaatacattgacggaatctgctcaatatcgccgcggaaagtctccagcgcgctcgcaagctgctcagcgctgaaagtcaccggacgctcctgcacgatttgaccatcggcgtcagaggtatccgtgcgctgccccagacgggcaataacacgatagcgtttgtcagaatccagcaggtactgcgaaaattttgtcgcttcgccgaggcaaatcggcaacatgccggtcgccagcgggtccagcgcgccggtatgcccggcgcggttggcattgtagatgcgcttaactttctgcagcacgtcattgctggacataccctgcggcttatccagcagcagaacgccgtgaatgtcgcggccacgacgacgaggacgactcatcagtcctccttgctgtcgtccgggttcacacgacgttcttcgtcatgtttcaccacgttagttaccaggttggacatacgcatcccttccaccagcgagttgtcgtagaagaaggtcagttccggcacgatgcgcagacgcatcgctttacccagcaagctgcggatgaaaccagacgcttcctgcaacgctttgatgcccgcttttactgcgtcttcatctttgtcgttcaaaaaggtgacaaacactttggcataggccaggtcacgggacatttcgacaccggagacggtagtcatcatgcccaggcgcgggtctttaatttcgcgctgcaggatgattgcgatctctttttgcatctcttgcgctacgcgctgagggcgaccaaattctttcgccataataaattctccagaataaagacaaaaaaggggccataagcccctttttaaatttcttgccgggtggcgcttcgcttacccggcctacgcctaatcatcttctaaggattttggattgcaacaaggcggcaagctcgtaaatccccgggagcatagataactatgtgaccggggtgagcgagcgcagccaacgccgttgcggcccaaaagacgacgaagattaagcgatggtacgttggatctcgataatttcgaatacttcaatcatatcgccaacgcgaacgtcgttgtagttcttcacgccgataccacattccatgccgttacggacttcgttaacgtcatctttgaagcggcgcagggattccagctcgccttcatagataaccacgttgtcgcgcagtacgcggattgggttatggcgtttaatcgtaccttcggtaaccatacagcccgcgatcgcgccgaatttcggcgatttgaacacatcgcgcacttcagccagaccgataatctgctgtttcagttccggagacagcataccgctcatcgccgctttcacttcgtcgatcaggttatagatgacggagtagtaacgcagatccaggctttcagattcgatcactttacgcgcagaggcatcggcacgaacgttgaagccaaccagaatggcgttggacgccgcagccagggtcgcgtcggtttcggtgataccacctacgccagaaccgatgatcttcactttcacttcgtcggtagacagtttcagcaaagagtcggagatcgcttccacagaaccctgtacgtcggccttcagcacgatgttcacttcgtgaacttcgccttcggtcatgttggcgaacatgttctcaagtttagatttctgctgacgcgccagtttaacttcacggaatttaccctgacgatacagagcaacttcacgcgctttcttctcgtcgcgaacgacggtcacttcgtcacccgcagccggaacgccggacaggccgaggatttccaccggaatggacggccccgcttccagcacttcctgacccagttcgttacgcatcgcacgcacgcggccgtattcgaagccacacagcacgatatcgcccttatgcagcgtaccttcgcgtaccagaacggtagccaccggaccacgacctttatccaggaaggattcgatcaccgcaccgctcgccatacctttacgaacggctttcagttccagaacttcggcctgcagcaggatagcgtccagcagttcgtcgataccggtgcccgctttcgcagacacgtgaacgaactggctctcgccgccccactcttccggcagaatgccgtactgggacagttcgttcttaacgcgatccggatcggcttccggcttatcgattttgttcaccgcaaccacgaccggcacacctgccgctttcgcgtgctggatagcttcgatagtctgcggcatcacgccatcgtctgccgctaccaccagaaccacgatatccgttgcctgggcgccgcgagcacgcatcgaggtaaacgcggcgtgacccggggtgtccaggaaggtgatcatcccgttgtcagtttcaacgtggtaagcaccgatgtgctgggtaatgccgcccgcttcgccagaggccactttcgtggaacgaatgtagtccagcagagaggttttaccgtggtcaacgtgacccatgatggtcacaaccggggcgcgcggttcagccgcagcgccggtatcacggtcgctcattaccgcttcttccagttcgttttcacgacgcaggataactttgtggcccatctcttcggcaaccagttgtgcggtttcctggtcgataacctggttgatggtggccatagcacccagcttcatcatcgctttgatgacctgagagcctttaaccgccatcttgttcgccagttcgccaacggtgatggtttcaccgatcaccacgtcgcggttaacggcctgagcgggcttctggaagccttgctgtaaagaagaccctttacgcttgccgcctttaccgccgcgaaccgcagcacgcgcttcttcgcgatcggctttggattcggcatgtttgccttttttcgccggacgcgctgcttttgcattacggccacgaccacgaccgccttctacttcacgatcgttttcgtcttcggcctggcgagcgtgctgagaagtggtgacatgatagtcactggtgtcttctactggctcaggcgttgcggtccatttgttttcttccgccatgcggcgagcttcttctgctacacgacgcgcttcttcttcgagtttgcgacgtgcttcttcttccgctttacgcttcagctctgcagcttcattctcacggcgggctttttcggcctgggcggttttggtcatatcgtcagtctgttgattgctcactttgtctttttccgcagcttcacgtttcgctttttcagcggcttcacgcttagcttgttctgcggcctcgcgttcagctttttgttgcgcctcgcgtttggcctgttcttctgcctcacgacgggcttgctcttccgcttcacgctgcgcctgctcttccgcggccaggcgttcagcctcttgcggatcgcgtttcacaaaggtgcgcttcttgcggacttcgatttgtaccgatttactttttccaccggtaccaggaatattcagggtgctgcgcgttttacgctgcagcgtcagtttatcgggaccagaaaccgcttcgcggttcaggtgcgccagtaaagtctgtttttcttgtgcggacacagagtcgtcagcagatttccggatacctgcatcagcaaactgctgtaccaggcgatccacggaaacctgtctctctgcggccagcgcttttagggttacatctgtcatgctgttccttcctgctacagtttattacgcttcgtcgccgaaccagcaaatattacgggcagccataatcagctcaccggctttttcgtcggtcaacccttcgatatcagccagatcatcaatgccctggtcggcgagatcttccagcgtacaaacaccacgagccgccagtttgaaagccatatcgcgatctaatccttccagattcagcagatcgtcagccggtttgttatcaccgaggcttgcttcctggtcctgcgccagagtggccagtgcgtttttagcacgctcgcgcagtgcttcaacggtcggctcatcaaggccgtcaatttccagcagttctttcattggcacataggccagttcctcgagcgtggagaaaccttcttctaccagaacggtcgcgaactcttcatcaatatcaagatatttagtaaaaatctcgatagcggcatgtgcttcagcctgatgtttagcctgcaagtcatcaacggtcattacgttgagttcccagccgctcaattgcgaagccaggcggacgttctgaccattacgtccgatcgcctgcgccagattaccggcttcaacggcgatatccatggtatgtttatcttcgtccaccacgatagacgcgacgtctgccggcgccatcgcattaatgacgaactgcgccgggttatcatcccacagcacgatatcaatacgctcaccgcccagttcggtagagaccgcctgaacgcgcgcgccgcgcatccccacgcaagcgccgaccggatcgatacgtttatcgttggttttcactgcgattttcgcacgagaacccggatcgcgagccgccgctttaatttcaatcacttcttcgccgatttccggcacttcgatgcggaacagttcgatcagcatttccggcttggaacgggtgacgaacagctgcgcgccacgcgcttccggtcgaacagcatacagcacgccgcgaatacggtcgccagggcggaagttttcgcgcggcagcatatcttcacgcagaatcaccgcttcagcgttaccggccatcccttcggatttaatttccagagagatattgtcgcggttcactttcttcaccacgccagtgacaatttcgccttcctggtcgcggaactgatcgacaaccatcgcccgttcagcttcacggaccttctgcacgataacctgtttcgcagtctgcgtggtgatacggtcaaaggtgacagattcaatctgatcttcaacatagtcgccgacattcaggctttcgtcttcaaaacgcgccgcttccagcgtaatttccttcgtcggcatggtcacttcttcaacgatcaaccaacggcggaaagtatcaaaatcaccgcttttacgatcgatttctacacgaacatcgatctcctgctcatattttttctttgttgctgtcgccagcgcactttccagcgcttcaaaaattttttcgcgtggcagcgctttttcgttggagacggcttcaacaacagccaaaatttctttgttcatcgcgggcttttcacctcatccagactgttaaaagtggggaaccaggttcgccttctggatattactcagcgcgaacacttcatctttgccttcgactgtgacggtaatcatttcaccgtccaccgctttgataatgccctgccacttgcgacggttctgtaccgccatgcgaagaaccagcgcgacttcttcaccctggaaacgcgcataatgatcggcagtgaacataggacggtcgagacccggtgacgagacttcaaggttgtaagccacggagataggatcttcaacgtccagcaccgcgcttacctggtggctcacatcagcacaatcatcaacattgatgccatcttcactatcaatatagatgcgcagtgtggatgtgcgaccgcgaataaattcgatgccgaccagctcgtagcctaaggcttcaactggcgctgtaatcatctctgttaatttttgctctaatgtggacaagcccacccccaagacataaaaaaagggcctaaagcccagttattctgtagtcagataacaaaaaaccccgataaatcggggctttagataactgaaccctataaccgcaacggcggtctggtgtaccttccgaaagaatttttttcaaatccagctacgaaggacataatcttcacagtatatttgaaaaagaactctaagggaaagtggttgcgggggccggatttgaaccgacgaccttcgggttatgagcccgacgagctaccaggctgctccaccccgcgcctgaaacgtggcaaattctactcgttttgggcaaaatttgcaaatactgctgggatttggtaccgaggacgggacgtaaaatctgcgcacagtatagtgacctggcatgagttatgtcaaccctattcccaatatgcagatgaatgaatatcactcttcgttatactcatcccacctctccggcttatacacgcatgtcacaacgttatttcagtaaaccttcactaaacgcttcctgtctctgctaaaagatgattaaatgaaaactcatttattttgcataaaaatgcactaaagcagaaaccgatctcattatcagtcaatcaagcagggttctattctatgacgacgattcttaagcatcttccagcaggtcaacgtattggtatcgctttttccggcggtctggacaccagcgccgcgctgctgtggatgcgacaaaaaggagctgtcccatatgcctatactgcgaatctgggacaaccggatgaggatgactatgacgccattcctcgtcgcgcaatggagtatggcgcagagaatgctcgcctgattgattgccgcaagcagttggttgcagaagggatcgcagcgattcagtgcggcgctttccataatacgactggcggactgacctatttcaataccacgccgctgggccgtgccgtaaccggcacgatgctggtcgccgcgatgaaagaagacggcgtgaatatctggggcgacggcagtacctataaaggcaacgatattgaacgtttctatcgttacggcctgctgacgaatgctgaattacagatttacaaaccgtggctggataccgactttatcgatgagctgggtggtcgccatgagatgtctgaatttatgattgcctgcggtttcgactataagatgtcagtcgaaaaagcctactccaccgactccaacatgctcggcgccacgcatgaagcgaaagatctggagtttcttaactccagcgtcaagatcgtcaacccgattatgggcgtgaagttctgggacgagagcgtgaagatcccggcagaagttgtgaccgtccgcttcgagcagggtcaccctgttgccctgaacggtaaaaccttcagcgatgatgttgagatgatgctggaagcgaaccgcatcggcggccgtcacggcctgggtatgagcgaccaaattgaaaaccgcatcattgaagcaaaaagccgcggtatttatgaagcccctgggatggcgctgctgcacatcgcttacgagcgtctgttgaccggtattcacaacgaagacaccattgaacagtatcattctcatggtcgtcagctgggtaaactgctgtatcagggccgctggttcgactcgcaggcgttgatgctgcgtgacggcctgcaacgttgggtcgccagccagattaccggtgaagtgacgctggaactgcgtcgcggcaacgactactccatcctgaacaccgtgtcagacaacctgacctataaggctgagcgtctgaccatggagaaaggcgagtccgtattctcaccggacgatcgtattggccagttgaccatgcgtaatctggacattaccgatacccgcgagaaactgttcggctacgcgaaagcgggtctgttaaccgcctcttccgcgaccggtctgccgcaggttgagaatctggaaaacaaaggcaaataagcccgcgtcgttgatgcaacaggccgcgaaagcggccttttttgtgaatatcaccccaggttgatgcaaatggcggatttgccggttaatctaactggacaacatttcgcaccctgtcaaagcattgtgcagccatgtctttttcagtcatcattatatagtcaatgcccccgccaaaatccggcccagcgacagccagtaatgctgttgtagaatgaatttcttcatcccagctaaaaagctgtcgccaccttgtatcattttgattcagttcatcttccacactacgttggagaggaattgtccaccctcccagaagatcgccggaatagcaggcatcaactcgatacgggttgtcctgttcgtaatcacttaacgcgtcataccatgattcatacgctttctgctgcgtaacgcttaacccctcgcagactgacgaaacactgataacggaaagaggttccaggcactcaacctgtgtacacaattgccatggttcacgaaattcaatcttattgtaaaaagccagcaagtcatctggcacagctagcgtgcttaatgtatctacctcaacatcgtgccagaaaacaaagggctgccgatcttcccaggtaacatcgacaaagaagctcaataacccccgcctgggaagcagtggatcaaaccccgggagtaacgccaggtcactcaagtttagttgggcaacgaaagcaagcggaaaatcaaccaactgattctctatgcggatgtcaatttcggttaataaccgctgctgcactaaccgatacttttcctcgtcaaaatcttccgctggctgcccaagcagcttacgcccttcattgagcagctcataactcattttcatttcatgaacaaacctggcatttcgcgttttttcagctttcagctttagtacgcgagatgtggcattaaccgatttttttcgtataggccagctttgtcctaatggccagtcgggtagaccgcccaaccgcgatgcccccacctttactgtttccatatcccgcagacaacgtttaaatgcaatagcagcacgtgcctgttgcacgactttctcctgaatagcagagctcaaattggatgtgcgcaattcagcaatcaatccagcacgatcgaaaaataaactcattaatctcttccttagatattcggctcagtgcaaaggaagattagataaaactacttgagcaaaagatatggagggggataacagatacaagcatttcagattatagctgagcaactactggcttcaatgaacgaagatgatctcgtaatcggtggagtgaacctgacgcagggagatcaccagagaggacatacatgagtatgtatgtagggctatctcaacgtattgacggggccatgccagggacgcgtgtaagcgtgcttcaacctcctctctgagagcagtttcaacagacgaaaaaaaagacgcttttcagcgtctttctttcggaatattggtaccgaggacgggacttgaacccgtaagccctattgggcactaccacctcaaggtagcgtgtctaccaattccaccacctcggcacggatactgctattagcgcgggatatcgctggtcggctgggccggtgcagcaggttgagtctgctcggtcttcgccggcgcactcagattttcccactcgcttcctttattggttttgttgctattgatattacccaacaccagactgatgatgaagaacagcgtcgccaataccgccgtcattcgggtcatgaagttaccagaaccacttgaaccaaatagcgtagcggaagcgcctgctccgaaggaggctcccatatcagcgcctttaccttgctgcagcatgatcagacctacaaggccaattgccacaataaggaaaacaactaaaagagcttcgtacataatcaacctgttccttgcggagttgccgcgtaccaatgcttctaccaataaagcgggatttttactgtttcccactgaagcgggtgtgaatactaaccaaagcgaatgaccttcgcaagggcaatttaagcgcattgtatcaactgcggaaaaaaacagcaaaagcgttgttttttgcgggccgtaaggcggcaaccgccgcctttttagtcacttaaacgcttaaacggcttttaccgcatccgcgatacgatgggcgaatgccgtaacctgcgcttcatcctcgccttccaccatcacgcgaatcagcggttcggtaccggatttacgtagcagtacccgcccacgattgccgagcgtggcttctacgtccgccgttaccgctttcaccgcttcattttccagcggatcgccgctaccggcggtgtaacgcacgttaaccagaatctgcgggaacattttcataccgctgcacagatcgtgcagactcatatgattacgcaccatcgccgccagaacttgtagccccgctacaataccgtcgccagtggtcgttttatccaacagaataacgtgaccagagttttccgcgccgatgcgccagcctttttcctgcaatttttccagcacgtagcggtcgcccactttcgcccgggcaaacggaatgccaagctgcttgagcgccagctccagccccatattgctcatcagcgttcccaccgcgccgccgcgcagctgcccctggcgcagcccttcgcgcgcgatgatatacatgatctgatcgccatcgactttattgccttcatggtcaaccatgatgacccggtcgccgtcgccgtcaagcgcgatgccgaggtccgccttctccgccaacacgcgcgcctgcaacgcgcgcacgtcggtcgcgcccacttcttcgttaatgttgacgccgtttggctcacagccgatggcgataacggtcgcgcccagctcgcgcagcacattcggcgcgatatggtaggtagcgccgttggcgcaatccacaaccactttcaggccattgaggctcagttcgttcgggaaggtgcctttacagaactcaatatagcgtccggcggcatcgacgatgcggctcgctttacccagctcagcggagtctacgcaggtgatctctttttccatttcggcttcgatggcttcttccacatcgtcaggcagtttcgtaccgtcgatagagaagaatttaatgccgttatcatagaacgggttatgcgaagccgagataacgatacccgcctccgcgcggaaagtccgcgtcagataggcgacggctggcgttggcataggtccggtaaacgaggccgacagtcccgcagcggcaaggcccgcctccagcgcggactccagcatatagccggaaatacgcgtatctttaccgataatgattttacgcgagccatgacgcgccagcacttttccggcagcccaacccagtttaagcacgaaatcaggtgtaatgggggcattgcctacacgtccgcgaatcccatcggtaccgaaatatttacgattactcatagcgtttgtttccctttgcagacagagtggcttccaccacccgcatcgcctctacggtttctttgacgtcatggacgcgaatgatctgcgcgccctgcatcgcggcaattaccgcgcacgcaaggctgccgttcagacggtctgatggtcccacgttaagtaactgaccaaccatcgttttacgtgacatgcccaccagcagcggcaggttaaaatgatgaaactcacccagtcgcgccagtaaggtataattgtgagagagatttttaccgaaaccgaatcctgggtcgagcaacaatttctcttttgcgatgccggccttctcacaacgtgctatttgctcaataaagtagcgattcacctcggcaaagacatcgtcatatttcggcgcctcctgcatggttttggggttgccctgcatgtgcataagactgaccggcaagccggtttccgctgccgcttccaacgcgccgggttcggagagtgaacggacatcattgataatatgcgcgcccgcccttgccgcttcacggatcacctcgggtttagaggtatccacagaaatccacacttcaaaacgttgcgcgattgcttccagtaccggaataacgcgatccagctcttcttccacgctcacttctgccgcgcctggtcgcgttgattccccccccacatcaataattgtcgccccggcattcaccattaaattcgcatgtttcaccgcctcaatcagcgtgttatgcgcgccgccgtcggagaacgaatccggcgttacgttcaggatccccataacatgcggatgagtgagatcgagcgtggcgccctgagcgaagagtttcatggtcaaaatccctgttttatttatggtgagttaaaaaaagaaaaaccccggggcaagccccagggtttcggtgagcgctaaacataatgttgtaaaacaaatgcttatttgtcgcccagctgctctgacatcgtgttgcccgggttcggcgtgcgtggttcatcaaccggacgcggcgcctgaggcgtaccattgctgtcagagttattggtgccgtttggatcttcccagcccgcaggcggacgcacttcacgacgcgccatcaggtcatcaatctgcggcgcatcgatggtttcatatttcatcaacgcatctttcatcgcgtgcagaatatccatattgtcagtcaggatctgacgagcgcgattgtagttacgttcaatcagcgctttcacttcctggtcgatgatacgcgcagtttcatcagacatatgtttcgcttttgcgacgctacggccgaggaatacttcgccctcttcttccgcatacagcaacggaccgagtttctccgagaagccccactgggtgaccatgttacgcgccaggttagtcgcgactttaatgtcgttcgacgcgccggtggaaacatgctcaacgccgtagataatctcttccgccagacgaccgccgtacagcgtgctgatttggctttccagcttctgacggctggcgctgatcgcgtcgccttcaggcaggaagaaggtcacgcccagcgcacgaccgcgcgggataatcgtcactttgtgcaccggatcgtgttccggcaccaggcgaccgataatcgcgtggcccgcttcgtggtacgcggtcgactctttctgcgcttccgtcatcaccatggagcgacgttcggcgcccatcatgattttgtctttcgctttctcgaactcaaccatcgacacaacgcgcttgttaccacgagctgcaaacagcgccgcttcgttgaccaggttcgccaggtccgcaccggagaagcccggcgtaccgcgcgcaatgatcgccgcatcaatatccgtcgctaacggtacgcgacgcatatgcaccttcagaatctgctcacgaccgcgcacatccggcaggcctaccaccacctgacggtcaaaacggcctggacgcagcagcgccgggtccagaacgtccggacggttagttgcggcgataacgatgataccttcgttaccttcgaagccgtccatctcaaccagcatctggttcaacgtctgctcacgttcatcgtgaccgccgcccagaccagcgccacgctggcgacctacggcgtcgatttcatcgatgaagataatgcacggcgccgctttcttggcctgttcgaacatgtcacgcacacgagacgcgccgacaccgacgaacatttccacaaagtcagaaccggaaatcgtaaagaatggcaccttcgcttcacccgcaatggcttttgccagcagggttttaccggtacccggcgggccgaccatcaggacacctttcggaattttaccgcccagcttctggaaacggctcggttcacgcaggtattcaaccagttccgccacttcttctttcgcttcgtcacaacccgcgacgtcagcaaacgtggttttgatctgatcttccgtcagcatacgcgccttgctcttaccgaacgacatggcgcctttgccaccgccgccctgcatctgacgcatgaagaagatccagacgccgatcagcaacagcatcgggaaccaggaaatgaagatagaagccagcaggcttggctcttcaggtggttcgccaacaaccttgacgtttttagtcagcaggttatcaagcagcttcggatcattaatcggaatgtaagtcgtgtaacggttactatctttcttggtaacgttgatctcacgtccgttgatacgcgcttcgcgaacctggtcctgattgacctcttgcaggaaggtagagtaatccaccttacggccattagactcgctgggcccaaagctctggaatactgacatcagcacaacggcaatgaccagccagagtattaggtttttcgccatgtcactcaagggattaacctcttattacaactgtgttaaaaacagcgtcaggatactctatatccagtttctttcaaaccttacgtctgaaatctgccggttatcactttcgcccggtcgctacaatgtacacttcacgcgaacgcgcacgcgaagagtccggcttacgaactttaaccttcgtaaacagggagcgaatttcccttagatactcatcgaaaccttcgccctggaacaccttcactacaaaacttccgcctggcgccagcacatcgcggcacatctctaacgccagctccaccagatacatggcgcgggggatatccaccgccggtgttccgctcatgtttggtgccatatccgacatgacaacttgtactttactgtcacccacgcgttccagtaacgctttcatgacaagttcatcacgaaaatcgccctgaagaaagtccacaccaacgataggatccataggtaaaagatcacaagcgatgatgcggcctttgccgccaatctgcgtgaccacatactgtgaccagcctcctggcgcagcgccgagatcgactaccgtcattcccggcttaaaaagtttgtcactttgctgtatttcatcaagtttaaaccaggcacgggagcgtagcccctttttctgcgcctgttgaacatatttatcgctaaagtgttcctgaagccagcggcttgagctggcagaacgctttttacctgtcatttaactttcccgtcggggcagttcatcgtagccaatggcgtaaatttctacacgcctatttggcgatataagggagatggcggtagaatgacccgttttcaatcccaacgtaagcaaaaatatacgatgaatctgagtactaaacaaaaacagcacctaaaaggtctggcacatccgctcaagcctgttgttatgcttggcaataatggtttgaccgaaggggtactggccgagattgaacaagcgttagagcaccatgaacttatcaaggtgaaaatcgcctcggaagatcgcgaaacaaaaaccttgatcgtggacgctatcgtgcgcgaaaccggcgcctgtaacgtacaggtcatcggtaaaacgctggtgctgtatcgcccaactaaagagcgtaaaatctcgctgccgcgttaaggatatcctaaagtcgaacacaaaatctgtgtaaaacgaggggttttccacgagcaggagagcaaaatgccacgctctctccgttgataaaaggccgctatgcggcctttttcctttctttacaatacaccaacaatttgcgtattgagtactgcttaaaggtattccactttaagcacttcgtattccacatcgccgccaggcgttttgatcaccacgacgtcatcctgctctttgccgatcaggccgcgagcgattggcgagtttaccgaaatgagattttgcttaaaatccgcctcatcgtcgccaacaatgcggtaggtctgctcttcgtcggtgtccaggttcagcaccgtgacggtagcgccgaaaatcacgcgaccattgttcggcattttagtgacatcaatcacctgcgcattcgacagttttgcttcgatatctttaatgcgcccttcgcagaaaccctgctgttcgcgtgcagcatgatactccgcgttttcttttaaatcgccatgttcgcgcgcttcggcgatagcggcgatgatttcaggacggcgcacagatttcagaaaatccagctcttcgcgcagtttttcggctccgcgtaaggtcatcggaatagcttgcatttgttatacctcttgaacattcctgtagggggcaatgaactctaccccggctgctaagccagccccggcatatgccataccagggtcagaagcaaaaaaacaccaacccgggcgcgcagtcccaggtcagctacaatttcctctttgataaccattttaccctggagttccctatgggtcatcgtttactttttagggcgttgcgccgtagtatgacggcttgtttccagggtgttagcgcgagattatgcgattttccagatttatcatcggattgaccaccagtatagcgttcagcgttcaggccgcgaatattgacgaatacatcaaacagcttccggccggcgccaacctcgcgctgatggtgcaaaagattggcgcgcccgcgccggctattgattatcatagtcagcagatggcgcttcccgccagtacccaaaaggtgattaccgcgctggcggcgctgattcaactcggcccggatttccgttttacgaccacgctggagactaaaggcaacgtcgataacggcatcctgaaaggtgacgtaattgcgcgcttcggtggcgatccaacgctaaaacgtcaggatattcgcaatatggtcgcgacgctgaaaaagtccggcgtcacgcaaatcgacggcaatgtgcttatcgacacgtcgattttcgccagccacgataaagcgccaggctggccgtggaacgacctgacgcagtgtttcagcgcgcctcccgccgccgccattgttgaccgcaactgtttttctgtgtcgctttatagcgcgcaaaaaccaaacgatttagcctttattcgcgtggcctcttattatccggtaacgatgttcagccaggtacggactctaccgcgcggttcggcagacgcgcagtattgcgagctggatgttgtgcctggcgatttgaaccgttatacgcttaccggctgtttaccacagcgcgccgacccgctgccgctggcctttgctattcaggacggcgccagctacgcgggcgcgatcctcaagcaggaactgaaagaggccgggataacttaccgcggcacgctgctgcgccagacgcaggttaacgagcccggaacgatcgtcgccagtaaacagtcggcgccactgcacgatctgcttaagattatgctgaaaaagtcagacaacatgatcgccgatactgtttttcggatgattggtcatgtcaggtttaacgtgcctggcacctggcgggcgggatcggatgccgttcgccagatcctgcgccaacaggcgggaattgatatcggcaataccattattgccgacggttccggtctttctcgccataatctgatcgctcccgccacgatgatgcaggtgctgcaatatatcgcccaacacgataacgagctgaactttatctctatgctgccgctggcgggctatgatggttcattacaataccgcgccgggctgcatcaggcgggcgtagacggtaaggtttcagcgaaaaccggatcactgcagggcgtgtataatctggcgggctttattaccaccgcaagcgggcaacggatggcatttgtacaatatttgtccggctacgcggttccacctgccgatcagcgtaatcgccgaatcccgctggtacgcttcgagagtcggttgtataaggatatttatcagaataactgagtgcatttattgccggatggcggcgctaacgcgtcttatctggcctacaaagaacataataaaacgggccgcaaatgcggcccgttggcttttgtaggccggataagcgtaagcgccatccggctacgagattaacgtttgtagatgaactcgacgccttcttcgtcgtcttcatcccagtcgtcatcccagtcatcgtctgcgtcttcttccacttcagccagctgctggcgatgataatcgtcccacatgaactcgactttttccggctgttttgcttcttcagcctgcgcgatcggattctcgatgataaaggtcatcacatcccagcagagatctttcacccccagctgactggcagcggaaatcagatagtatttcccttcccagcccaacgcttcggcgatcgctttcgctttctcttccgcttcggttttatccatcagatcgatcttgttgaacactaaccagcgcggtttagccgccagatcctggctgtatttttccagttcgccaataatgatacgggcgttttccaccggatcggaaccgtcgatcggatcgatatcaatgaggtgcagcagtacgcggcaacgttcgaggtgcttcaggaagcgaatccccaggcctgcgccttccgccgcgccttcgatcaaccccggaatgtcggccaccacaaaactcttttcgctgtccatacgtaccacgcccaggctcggcaccagcgtggtaaacggatagtccgcgactttcggttttgctgccgataccgcacgaatgaacgttgatttaccagcgtttggcatccccagcatcccgacatccgccagcagcatcagttccagcagcaggtcgcgcttatcgcccggcgtaccattggttttctggcgcggcgtacggttaaccgaggatttaaaacgggtattgcctaacccatgccagccgcccttcgcgaccaacagacgctgaccgtgtttggtcatgtcgcccatcgtttcaccggttccctggtcgataacgcgcgtaccgaccggcactttgatggtcacgtctttaccgcgtttaccggtacagtcgcggctcgcgccattctgaccacgttcagcgcggaacgatttttcaaagcggtaatcgatcagcgtattcaggttttcatcggcttccatccagacgtcgccgccgtcgccgccatcaccgccgtccgggccgcctttcgggatatatttttcgcggcggaagctcacacagccattaccgccatcgcctgcaacgaccagaatcgatgcttcatcaacaaacttcattttattctccgtaaatcattcgcctgagcggggttgcgaaaccaccgtttcatgcttgcgtaaaccgccccaaatacgatgaccaatggcggaatacatcgcgcccgcaaccacgacaaacgcaccgagataacctaaaaggtttaacatcggtctggcgaagaaatcgggccaggccatagataaaagatctgaaaacagcagggtaaatagcggtgtaagcgtgattatcgcgctcacctgcgccgcctgccaacgcgccatcgcttccgccagggcgccatatcctaccagcgtatttagcccgcagaaaatcaaacaggcgagctgccagtcgctcagttgcgctatcaccatcggttttgccagcggcaagagcgctatcgtacataaagtgtacagtaaaaacaggatctgctgcgagccagacgtcgcaataatactttttgcgccacgccatagctcacccacaccatcgccgcgcctacgccaaaaataacgccccaggtgtagtcggtcagtcgggtaaaaatctcgatcagactggtgttaaaaaacatcaccagcccgctcaataacatcagcgcgccaatcacctgcgtaccgcgcatcttttctttcagaataaagacgctggcgaccatcatgccaaccggcgagagctggccgataacctgcgacgcggttgggcttaaatattgcagggaagaactgaacaaaatgaaattaccgaacagtccgcaggtcgctatcgccaataacaccaaccagcgcggcttacgaaaaatacgcagcggcggcagctttctttttactgccagtatcgccccgaggccaatactggccattaagaagcggtagaagacaatggttgaaggctccatcacctccagcacttgcttcattgctattggcaacgctccccagcacatcgcggtagtgagcgctaaaagaatgccaatgcctgcctgctgcttcatgccgtgttccctgcaaagacccgttaacggcattcgcacagccacacgggtatattttagtcggccatcgaatgtaaaaagccccgcaacaggtgcggggctttcatccgttaccggaccacaaaaaacttactcagcaacgatgctgatgtatttacggtttttcgggcctttaacttcgaatttcactttaccgtctgctttagcaaacagagtgtggtcacgaccgcaaccaacgttggtgccagcgtggaatttagtaccacgttgacgaacgatgatgctgcctgccagaactgcttcaccgccaaagcgttttacgcccagacgtttagcttcagaatcgcgaccgttacgagtcgagccgccagcctttttatgtgccatttaatctgctcccctaatcttaagcgctgatgccggtaattttcacatcagtgaaccactgacgatggccctgctgcttacggtagtgtttacggcgacgaaacttaacgattttaactttctcgccacgaccgtgggcaacaacttcagctttgattacgccgccatcaacgaaaggaacgccgattttgacttcttcaccgtttgcgatcatcagaacttcagcgaactcgatagtttcgccagttgcgatgtccagcttttccaggcgaacggtctgaccttcgcttactcggtgttgtttaccaccactttggaaaaccgcgtacataaaaaactccgcttccgcgcacacctttcaatgattcagagcgcgctataaatattcacaatagggcgcgaatattacgcaaattgcacggctttgacaagtgctaccatcaatacatgaagaaaaaaaacacaacgcatacggtaacgtttatctgcggcgttttttcagtacaatcagggtatatttctaaccataaaccctacgttacctcattcagacatgggataatcggggcgataagcccggcttttgcgatgaatttagaaaaaatcaacgagttaaccgcgcaagatatggcgggtgtcaatgcgacaatccttgaacagcttaattccgacgttcaactgattaatcagctaggatattacattattagcggcggcggaaaacgcattcgtccgatgattgccgttcttgccgcgcgcgcggtgggttatcagggtaacgcgcacgtgactatcgccgctctgatcgagtttatccacacggcgacgctgctacatgatgatgtggtggatgaatccgatatgcgtcgcggcaaagcgacggcaaatgccgctttcggtaatgccgccagcgtgttggtcggcgactttatctatacccgcgccttccagatgatgaccagcctcggctcgttaaaagtgctggaagtgatgtcggaagcggtcaacgtgattgcagaaggcgaagtgctgcaattgatgaacgtgaatgacccggacattaccgaagaaaattacatgcgggtgatttacagtaaaacggcccgtctgttcgaagctgccgcccagtgctccggtattctcgctggttgtacgcctgagcaagagaaagggttgcaggactatggtcgctaccttggtacggctttccagctcattgacgatctgctggattacagtgccgacggcgagcatctcggtaaaaatgtgggtgatgacctcaatgagggcaaacctaccttaccgttgcttcacgccatgcgccacggtacgccagaacagtcagcgatgatccgtaccgctattgaacaaggtaatggccgtcatcttctggaaccggttctggaagcgatgaccacctgcggctcgctggaatggacgcgtcagcgagcggaagaagaagccgacaaagcgatatccgcgttgcagatattgccggataccccatggcgtgaggcgctaatcggtctcgcacacatcgcggtgcagcgcgatcgttaatgccgttctcttatcccgcgtactgcgcgggatatcccattaagttctaataaactccagataccctatcgcctgtttttcacatactcatccaggatttcccctggcatattctgaatattgccgccacttacatgaactttttagaacattccttcacgaagcgttatagtatcgaacgtcgtcgggttgttaaaaccgtaagtgattaatctaaggagtgatggatgtatggaaagcaagcttattgactggcatccggccgatatcattgccggactacgtaaaaaagggacttcaatggccgctgagtcacgtcggaatggattgagttcatccacgctggccaatgcattaacgcgcccatggccgaaaggagagttgattatcgcgaaagcattgggaacggaaccctgggttatttggccatcgcgttatcacgatccgcgcacgcatgagtttatcgacagaacgcggcttatgagagcgcgtaataaaaacaaacagaatgtagagtaagtgcctgtaaaacaacccccgcatcgcgttcgcgggggttgttcagcgtacagaaggttattcgcctttcacgcgttcaatattcgcgcctagcgcgcgcagtttgtcttcgatgcgctcataaccgcgatcgatgtgataaatgcgatccacaatcgtcgtgccttccgcaatacagcccgccagcaccaggctcgcagatgcccgcagatctgtcgccatgacctgggcgccagagagcgtttctacgccatggcatatgacggtattgctttcaatttccgcacgcgcgcccatgcggctgagttcaggcacgtgcataaagcggttttcaaagacggtttcagtgataaagcccgtcccttccgccaccaggttcagcaacgtgaactgcgcctgcatatcggtcgggaatgccgggtgcggcgcggtacggacattgaccgccttcggtcgtttgccgtgcatgtccagactaatccagtcctcgcccacttcgatatccgcgccagcatcgcgcagtttcgccagtaccgcgtccagagtgtccggttgcgcgttacggcagaggattttgccgcgagagatcgctgccgccaccaggaaagtccccgtttcgatacgatccggcagcacacgataaacgccgccgcccagacgctctacaccctcgatcgtaatacgatcggtgccctgcccggcgatcttcgcccccagcgtaaccaggaagttagcggtgtcgacaatttccggctcgcgcgcggcgttttcaatgatggtcgtcccttccgccagcgtagcggcgcacataatggtgacggtcgcgccgacgctgaccttatccatcacgatatgcgcccctttaagacgcccttctacggaggcctttacgtagccctcttccagcttgatggtcgcacccagttgttccagaccggtaatatgcagatcaaccggacgcgcgccgatagtacagccccccggcagagagacttgtccctgaccaaaacgggcaaccagcggccccagcgcccatatcgaggcgcgcatggtcttaaccagatcataaggcgcgcagaacacgttcacctggctggcgtcaatgtgtaccgatccattgcgttccactttcgcgcctaattggctcaggagcttcatcgacgtatccacgtctttcagttttggaacgttttggatctctaccggttcttctgccagcagagcggcgaacaggatcggcagcgcggcgtttttggcgccggaaattgtgacttcgccctggagcgtcgttggcccctgtacacgaaatttatccattattgtattctcagttaagcattcatctccgctaccggcaggttacccgtagcttaaaatccgttaagtttacgatcgcgcgcccattccgccggggtatatgctttgatcgatacggcatggatacggttgtccgcaatgtactccattagcggcccatagaccgtttgctgtttcttgacccggctcatgccgtcaaacatctcgcccacggcaataacctgaaagtgactgccatcgccggagacgtggacttcctggagggagagggcattcatcagcacactctgaatttcatgattttccatgggttctttattcgtcaaatagtgaaaacagcccaacatcttagagcaaagtcgcgccgtcttaaataagcaaaagattacgctgataaatcagcgcggtaaaagtgccggatggtgctgctaacgcaacttatccggcctacggggatcatgcgaagtgtaggccggataaaccatccggcattcattacatacggggaagtacgtcttcgggcaagttatataattgcgccagcgcgtaaaccttgtcgttaacgccagacagcgacacggcattgccctgcttttttgcctggttcacaaggtgcgccagcagcgccagtccccccgtatctaccctggagatctggctcaggtcgatacgggtaacgccattcatcgcttctacgcgcgcgtcccatagcggcgccaacacgtcctgatccagctctcccgccagcaccagagtgtccgcctcacgcgtccaggtgagttgcggcgtcattactgtttctcgtccaaagtaattttctgttgagagatagatttcagttgtgcggtcaggccgtcgatgcctttagtacgcagcaggtcgctccactcattttgcttggtggtgatcatgctgacgccttccgcaatcatgtcatacgcctgccagttgccggtctgggtgttttttcgccactggaaatccaggcgtaccggcggacgaccgttgggatcgataatcgttacacggataggcacaatggtcgcatcgcccagcggttgctcaggcgctatctggtaagtctgaccgtggtacatcgccagcgcctgaccgtatgcctgtttcaggtattcgcgaaacgctgcaaaataggcttcacgctgcgccggggtcgcctctttgtagtagcggcccaacaccagcgcgccggcatattttacctgcacgtacggcagaagttcctgatcaacaacgtctcgcaggtaatccggattggcacgaattttcggctgttcgtttttcaggcgatcaaaagttttctgcgccgcctcgttcatcagtttataaggattgctctgatccgctgccgttgctgcgcttaatggcgcaatgaccagcagggccaccatcatcagtcgtttaaacatgcctcaattctcctgagattatttcgtttcgcccgcgggcgttgtggcttcagtatgaccttccgttgcggctggcgcatcgccagaattcttattgtcgtcgcctttgctgttataaaggaactggccaatcatatcttccagcaccattgcagacttggtgtcctgaatcgtactcccatctttgaggatagacgttcccagctcaggatcttcaaaaccgacgtttaatgccagatattgctcccccagcagtccggaagttcgaatactcaacgagctggtatcgggaatatggttataacgctcttcgatgtcgagcgttacgcgcggcaggtatgttttcggatcaagcgagatatcttcaacccgcccgacaaccaccccgccgatgcgtaccggggaacgcactttcagaccgccgatgttatcgaaggtcgcataaaccttataggtcggctccgtgcgcatagaggtcacatttgccgccttcaggcaaacaaacagcgccgccagcaacgctaccagcaaaaaaacgcctacccaaatttcattttttttcgtttgcatgaactcaattcccaaacatcagtgcggtcagcacaaaatccagccccagaacggccaacgatgcgtgaaccacggtacgcgtcgttgcccggctaatcccggcagaagtcggtattgcgtcataaccgttgaataacgcaatccatgttaccgtaatggcgaacaccacgctctttatcagacagttcaccaggtccatacgccagtcgacggcattctgcatcgcggaccagaagaacccggcgtcgattcccttccagcttacgccgaccagcgagccgccccagataccgaccgccacaaagataatggtcagtagcggcaatgaaatcacgcccgcccaaaagcgcggcgaaatcacccggcgcaatggatcgaccgccatcatctccatactggagagctgctccgtcgcccgcatcaggccgatttccgccgtcaacgccgacccggcccgcccggcaaacagcaacgccgcgaccaccggccccagctcgcgcagcagcgaaagcgccactaacatgccaagactggtctccgcgctgtaagtggtcagaaccagatagccttgcagccccagcaccataccgatgaatacgccggagacaataatgataagcattgacaagacgcccacattataaagctggcgcaccagcagcggcgcatgtttgcgaaactccggcttaccgataatcgcattgaataacattaacccggcgcgcccgaacgtcctgacggttttgatcccgctgtgtccgagtgctgccagcgcatttaacagcatgagtggcttaactccctgtttcgagtaaatcaaggtgatagtcgcccgccggatagcggaacggaaccggcccgtcggcaatgccgtcaaggaactgacgcacgcgcgggtccgtattctcctgcaacgcctgagcgctaccgtgagcgacgatttttttgtccgccatgatccaggcgtgatcagcaatactgagcacctctggcacatcatgcgagaccaccacgcaggtcacgcccagcgcgctgttcaattctgaaatcagcttcaccagaacgcccatggtaatcgggtcctggccgacaaacggctcatcgaacatgatgagatccggttccagagcgatggcgcgcgccaacgcggcgcggcgcgccatcccaccggagagctcggaaggcatcagttttgccgcgccgcgcagcccgacagcttccagtttcatcatcacgacgctttttagcagcggcgcgggtaaattggtgtgctcccgtagcggataggccacattgtcaaacacgttcatgtcggtaaacagcgctcccgactgaaacagcatactcatacgtttgcggacggtgtagagccgcgaacgggacatggccggcacattctcgccatcaaataagatctcgcccttatccggcgggatctgtccgccaatcaggcgcaacagcgtggttttaccgatgcccgacggccccatgatcgccgtgatcttcccgcgcggcaccgtcagggaaatattatcgaaaatgcagcgttcgccacgggaaaagctgacgtcgcgcatatcgactaaattggccgcagactgacccattgattcatccttcgtattgccttgttgaggtaaccatggcgctgaatttaaccatgggttcgacataattacagaatattaactgacagggttagcgaaagctggcattcgttttactttttagccgcataaagtcaaaattaggacttcgttacggcttccagatatcccttccaggggaccggcgagtatacctgaagaaaggactttagatgcttttagcgatggcgctactcataattggtttgcttctggtggcctacggcgccgatcgtctggtgtttgcggcctctattttatgccgtacattcggtattcccccgctgatcatcgggatgacggttgtgagtatcggcacctcgctgccggaaattattgtgtcggccgccgcatcgctacacggtcagctcgatttggccgtcggcgcggcgctcggttctaacatcaccaatattttgctgatcttagggctggcggcgctggttcgtccatttaccgtgcattccgatgttctacgtcgcgaattgccgttaatgttatttgttagcgtggtagccggttccgtactgcatgacggacagttaagccgcagtgatggtatctttctcctgcttctggctgtgctatggctgttattcattgttaaaatcgcgcgtctggccgaacgccaggggaatgacagcctcacccgcgaacaactggcggagctgccgcgcgaaggcgggctccccgtcgcgttcttatggctgggcattgcgctggtcatcatgccgatggcgacgcgcatggtaatcgataacgctacggtgctggcgaactatttcgccatgagtgaattaacgctcggtctgacagtcatcgccgtcggcaccagtctgccagagctggcgacggcgattgccggcgtgcgaaaaggcgaaaatgatattgccgttggtaatctcattggcgccaatatttttaatctcgctatcgtgctgggactgcctgcgctgatcgcgccgggggagatcaatccgctggcgtttgggcgtgattatagcgtgatgttgctggttagcgtggttttcgctttactttgctggcggcatccgcgtcagattggtcggggcgcaggtatactgctgaccggcgggtttatcgtatggctggcgatgctctattggctatcgccacttcttgttggataactggaaacggattatgtcgcatttagcgttgcaaccggggtttgactttcagcaggcaggcaaagaggtcctggaaattgaacgtgaaggcctggcggagcttgatcaatatatcaaccagcatttcacgctggcctgtgaaaaaatgttcaactgcaccggaaaagtggtggtcatggggatggggaaatccggccatatcggacggaaaatggccgccacgttcgccagtaccggcacctcttccttttttgtacatccgggcgaagccgcgcacggcgatttggggatggttacgccgcaggatgtggttatcgctatctccaactccggcgaatccagcgagatcgcggcgctaataccggtacttaaacgtctgcacgtgccgttaatttgcattaccgggcgaccggaaagcagcatggcgcgtgcggcagatgtgcatctgtgtgttaaagtgcccaaagaagcgtgtccgttaggactggcgcctaccagtagtaccaccgcaacgctggtgatgggcgacgcgctcgctgtggcgttgttaaaagcgcgcggctttaccgccgaggatttcgctctgtcgcatcctggcggcgcgctgggacgtaagctactgctgcgcgtaagcgatattatgcatactggcgatgagatcccgcatgttaataaacatgccaccctgcgtgatgcgctattagaaattacgcgtaaaaatctcggtatgaccgtcatttgcgatgaatccatgaagatcgacggtatcttcaccgacggcgatttacgtcgcgtattcgatatgggcggcgatatgcgccagttggggatcgccgaggtgatgacgccagggggcattcgcgtgcgtcccggtattctcgctgtcgatgcgctgaatttaatgcagtcccgccatatcacctccgtactggttgctgatggcgaccagttactcggtgtgttacatatgcatgatctcctgcgtgcaggcgtcgtgtagaaactcaaggataattaacgatgagtaaagcaggtgcgtcgcttgcgacctgttatggccccgtcagcccccatgtcatgaccaaagcggagaatatccgcctgctcatcctggacgtggatggcgtattgtctgacggcctgatttatatgggcaataacggcgaagagctgaaggctttcaacgttcgtgacggctatggtattcgctgtgctttgacctccaatatcgaggttgccattattaccggacgaaaggctaaacttgtagaagatcgctgcgccacgctggggattgtccatctttatcagggacagtcgaataagttgatcgcctttagcgatctgctggaaaaactggccattgcgccggaaaatgttgcctatgtcggcgatgatctgattgactggccagtgatggaaaaagtggggttaagcgttgccgttgcggatgcgcatccactgctgatcccccgcgctgactatgtgacgcacattgccggcgggcgcggcgcggtacgtgaggtgtgcgatttgctgctgctggcgcagggcaagctggatgaggccaaagggcaatcgatatgagtaaaaccagacgttgggttatcattctactgtcgctggccattctggtactgattggtatcaatctggcggataaagacgatcctgctgccgtgatggtcaacagcaacgatcccacgtataaaagcgagcatacggataccgtcgtgtacagtccggaaggcgcgttgagctatcgtctgatcgcgcagcacgttgaatatttttccgatcaggcggtctcatggtttacgcaaccggtattaaccacctttgataaggataaagtgccgacatggtcgatcaaggccgataaagccaaattgactaacgatcggatgctctatctgtatggccatgttgaagtcaacgccctggtgcctgacgctcaattacgcagaattaccaccgataacgcgcagattaatctggtgacgcaggatgttacctcgaacgatctggtgacgttatacggcacaacatttaactccagcggactgaaaatgcgcggtaacttacgcagcaagaacgccgagctgattgaaaaggttagaacctcttatgaaattcaaaacaaacaaactcagccttaatcttatgcttgccggctcgctgctggccgccagcattccggctttcgccgtcacgggcgataccgaacagcctattcatattgactcggatcaacagtcgctggatatgcaaggcaacgtcgtgacctttacgggcaacgtggtgatgacccagggcacgattaagatcaacgccgataaagtcgtggttacccgccctggcggcgaacaggggaaagaggtgatcgacggttacggcaatccggccaccttctaccagatgcaggacaacggtaagccggtgaaaggccacgcttcccatatgcactacgagctggcgaaagattttgtggtgctgaccggcaacgcttatctggagcagcttgacagcaacattaccggcgacaaaatcacctacctggtgaaagagcagaaaatgcaggccttcagcgagaaaggcaaacgcgtcaccaccgttctggtgccgtcgcagttgcaagacaaaaacaaaggccagactccggcgcaaaagaagagtaactaattcgttatggcaacattaactgcaaagaatctggcgaaggcctataaaggccgtcgcgtagtggaagatgtcagtctgaccgttaactccggggagattgtcgggctgctcggtccaaacggcgcgggtaaaaccaccaccttttatatggtcgtcggtatcgtgccgcgtgacgcaggcaatatcatcatcgatgatgaagatatcagtctgctgccgctgcacgcgcgcgcgcgccgcggtatcggctatttgccgcaggaagcctctattttccgccgtctcagcgtatttgataacctgatggcggtactgcaaattcgtgacgatttgaccgcagaacagcgagaagaccgcgccaacgagctgatggaagagtttcatatcgagcatctgcgcgacagcatgggacaggcgctgtccggtggtgaacgccgtcgtgtagaaatagcccgcgcgttggccgctaatcccaaatttatcctgctggatgaaccctttgccggcgttgacccgatttccgttatcgacatcaaacgcattatcgagcatctgcgcgatagcgggctcggcgtgctgatcaccgatcataacgtccgtgagacgctggcagtctgtgaacgcgcctatatcgtgagccagggccaccttattgcccacggtacgccgacagaaatcctgcaagacgaacacgttaagcgtgtatatcttggggaagacttcagactctgatagggtagagggctatgctgctctagcgggagaaaacgactctgaatatgaagcaaggtttgcaactcaggcttagccaacaactggcaatgacgcctcagctacaacaggccatccgtctgttgcagttgtctacgctggaacttcagcaggaactccagcaagcgctggaaaataacccgctgcttgagcaaaccgatcttcatgacgaaatcgacacccagcaacctcaggataacgatcctctcgataccgccgacgcgctcgaacaaaaagagatgccggaagagctgccgcttgacgccagttgggatgaaatttacaccgccgggacgccgtccggccccagcggcgattatatcgacgatgagctgcccgtctatcagggcgaaacgacgcagtcgttgcaggattatctgatgtggcaggttgagctaacgcccttctcggataccgatcgcgctattgcgacatccattgtcgacgcggtagatgataccggctatctcaccgtatccctggacgaaattcgcgaaagcatgggcgatgtagaggtggatctcgatgaggttgaagccgttctgaagcgcattcagcgttttgatccggtaggcgtcgcggcaaaagatcttcgcgactgtctgctgatccagctttcacaattcgacaaatccacgccgtggctggaagaggcgcggctcattatctgcgatcatcttgatctgctggccaaccacgatttccgcacgttgatgcgcgttacccgactaaaagaagaggtgctgaaagaggcggtaaacctgattcagtcgctcgatcccagacccggtcaatcgatccagaccggcgagccggagtacgttatcccggatgtgctggtacgcaagcataacggtcgctggacggtggagcttaatagcgacagtattccccgtttacagattaaccagcactatgccgccatgtgcaatagcgcgcgcaacgatgccgacagccagttcatccgcagtaatttacaggatgcgaaatggctgataaaaagccttgaaagccgtaacgacacgctgctgcgcgtcagtcgctgcatcgtcgagcaacagcaagccttttttgaacagggcgaagaatatatgaaaccgatggtactggcggatatcgcccaggccgtcgagatgcacgaatccaccatatcccgcgtgaccacgcagaagtatctgcacagcccgcgcggtatttttgaactcaaatatttcttttccagccacgtcaataccgaaggcggaggcgaagcctcttccaccgcgattcgcgcgctggtgaagaagttaattgcggcggaaaaccccgcgaaaccactgagcgacagcaagttaacctctctgctgtcagaacaaggtatcatggtggcgcgccgcactgttgcgaagtaccgagagtctttatccattccgccgtcaaaccaacgcaaacagctggtttgacccaaccgataaggaagacactatgcagctcaatatcaccggacataatgtcgaaattactgaagccctgcgtgaatttgtgacgacaaaattcgccaaacttgaacagtattttgagcggattaatcaggtatacgtggtgttgaaagtggagaaggtcacgcacatctcggatgcgacgctacacgttaacggcggcgaaattcacgccagcgcggaaggccaagatatgtatgccgccattgacggcttgattgataaactggcaaggcagttaaccaggcataaagataaactgaaacaacactaattgtccgggcagttagccagtgcaggacggcctgttgtgtgacacaacgggccatttgtacagttagcgctccgaacctggccatcaacctgacaggacaggttcttaggtgaaattatgataaataacgatacgactctacaactgagcagtgtacttaaccaggagtgtacgcgtagcggcgttcattgtcagagtaagaaacgcgcgctggaaatcatcagcgaactggcggcaaaacagctcagtttacctcctcaggtcgtgtttgaagccattctgacacgcgaaaaaatgggcagtaccggtattggtaatggtatcgccatcccgcacgggaaactggaagaagataccttacgcgccgtcggcgtgttcgttcagctcgaaacgccgatcgcgttcgacgccatcgataaccagccggtcgatctcctcttcgccctgctggtgcccgccgatcaaactaaaacgcatctgcacacgctgtcgctggtggcgaaacgtctggcggataaaacgatctgccgccgcctgcgcgcggcgctgaatgatgaagagctgtatcaaatcattactgacaccgaaggtgagcagaatgaggcataacaactcaatggcatttatttctgtcgttgtgaggagaaacggtacatggtactgatgatcgtcagcgggcgttccggatcaggtaaatctgtcgctctgcgcgcgctggaagatatgggattttactgcgtggataacctccccgtcgtgctgttgcccgatctggcgcgaacgctggccgatcgccagatttccgccgccgtcagcattgatgtgcgcaatatgcctgaatcacctgagatttttgaacaggcgatgaataatctgcctggtgctttctcgccgcaattgctgtttcttgatgccgaccgcaataccttgattcgccgctacagcgacacgcgccgtttgcatccgctttccagcaaaaatctttctttagagagtgcgatcgataaagagagtgacttgctggagccgttacgctcacgtgcggatctgatcgtcgacacttcagaaatgtccgtccatgagctggcggagatgctgcgtacccggctgttgggcaaacgcgagcgtgaactgacgatggtatttgagtccttcggctttaaacatggtatcccgattgatgcggactatgtgttcgatgtccgctttctgcccaacccgcactgggacccaaaactgcgccccatgaccgggcttgataagccggtagccgcgtttcttgaccgacacacagaagttcacaattttatctatcagactcgcagctatcttgagctatggttaccgatgctggagaccaacaaccgcagctaccttaccgtcgctatcggttgtaccggcgggaaacaccgttcggtgtatattgcagaacagctggcagactacttccgctcgcgcggtaaaaatgtccagtctcgccatcgcacgctggaaaaacgcaaaacatgaccgtaaagcaaactgttgaagtcaccaataagctgggcatgcatgcccggcctgccatgaagcttttcgaactgatgcagggttttgacgccgaggtgctattacgcaatgacgaaggcaccgaagcggaagcaaacagcgtcatcgcgctgttaatgctcgactccgccaaagggcgtcagattgaaattgaagccaccggcccgcaagaagttgaagcgctggcggcggttatcgcgctgttcaattccggctttgacgaagactaaacctccccctctataccctatttcccccaacgccgtcccggtatttgatgacagtcaccccaaaaccgggcgtgttacgcctgcctgcctcttgtcccgcagccccaccctttcgtaagatttgtacatttcgtgcgctttacctatgcataaaaacattaagaaaaccttaaaaaatttcgtttaggttttgtttaagttctttgtccatactaaatttatgtgaataaatttttccaggacttgccatgatcctcttatcgaaacagactccgctgggcgccggtcgacatcgtaaatgctatacgcatccggataatgcccggcgttgcataaaagtcatttacaaccgtgaccacggcggtgataaagagattcggcgtgaactgagctactatgcgcatctgtcccgctacctgacagactggagcgctatcccccgttattacggcacggtagaaaccgattgcggcaccggctatgtctacgacatgattaccgatttcaacggcgcgccctctattaccctgaccgagttcgccgcgcaatgtcgttatgaagaggatgtcgctgtcctgcggcggctactgaaaaaactgaaacgctacctgctggataaccatattgtgacgatgtcgctgaagccgcaaaacatcctgtgccagcgtatcagcgagtcagaagtggttccggtggtttgcgacaatctgggggaaagtacctttatcccgctggcaacctggtcaacatggtgctgtgaacgcaaactggagagagtgtggcagcggtttatcgcccagcctgcgctggccgttgccctggagagggacgcgcagccaaaagacaagaaacggctggcgcttacttctcacgaagcttaatggcctgtgcttatcaggcccggacgacacagatcgcaggccggataaggcgttcgcgccgccattcgacaaaattaattaagctggttgcgcgtcataaaagattccccacccagttggcgcatctggcgcataatccacgcctgccggctacgcacatagccggaaggcgcattcgccttatagcgaatcgggttaggcagcacagccgccagtaacgcggcttcagacagactcaagcgactggcaggtttatgaaaataccgttgtgccgcagcctccacgccgaaaataccatcgccaaactccgcgatattcagataaaccgtgaggatgcgctttttgctccagacagtttcaatgcccagcgttagcccggcctccagacctttgcgcacccaactgcgtccatcccataaaaagagatttttcgccgtttgctgcgaaagcgtagaggcgccgcgaatacggctctcattccgctcattatgcgccagcgctttttcaatcgccggaacatcaaagccccagtgctcagggaacttctggtcttccgccgcaattaccgccagccccatccacggcgagatatccgccatactgacccagtcagaatgcgccacataaccgaactctccgccgagccaggcgctaatctgccgttccgccatcaccgccgaaaaaggcaccggaaccacgctaaacagcgcaatgccgccgccccaaaagacggcgagcgcagcaaggatacgtaaaagtagacggcgcaaaaacgttaacggcgcgatgcgtcgtttgctcattccgccagaaccagcacgcgcgacactaatttatcaatgccgcttgccgcctgggcgatatcctgcgccagcatataggcaggggtggtcacgaccttgttatcctcgtccacaacgatatcatcaaccgggcaaggtacgtgttcggcgcccatctcttcaagtacttcagcggtatcaatatccgtccctattgtcagacgtagcgggaagtcaaagattttcggcaacattgcgggcgcgatacagatgaatcccagcggcttgccggactggtgcatggccttcgccagcgcgacgacatcgctatccacccggcattcgctcccctggctggcgaaattactcaggttcttcgccgcgccgaaaccaccaggcacaatgagcgcatccagctcctctggctgagcctgggacaggggacgaatatcgccccgcgtaatacgcgccgcctcaatcaggacgttacgcgtttccgccatcgcttcgccggtcaggtgattaataacatccgcttgtggtttatccggcgcgaagcagacagcctgcgcgccgctgcgggcaatggccagcagcgtcagaacggcctcatgaatttcggtgccgtcatagacgccgcatccgctgagcactacgccaatttttttcatggtgaacatcctcctgcaaccgactcaagcccattaataattttgattaaaatgctacgcttcacacatttaaatgattcatgtaacaaatcatttaggatttgctatcttaactgcgtgcggcctgaaaacaggactgcgcctttgacatcatcataataagcacggcgcagccacgatttccctggtgttggcgcagtattcgcgcaccccggtcaaaccggggtcattttttttccgcgtttgccacccaggctttcagcaccgcgacatcgtgctgccactcctgcttcatctcttcaatccattccacgacattatcttcccaggcgggaagatccggcgactggatttgctggccaagttgttgcagatgacgcagccctaccgaaccggcggcgcctttaatcttatgcccttcctcaacaacgccttttttgtcacgcgccgttagattggactccagcacgcttaaatagccaggcatcattttttcaaacaccgcgagaccgtcggtgatcaatttaggcccaaccaactcgatgtattgttccagcatcgggatatccagcagcgcttgcgctttatcgctctcttcaggcgtcacggtactctcctctttatcggtggcatcccagaattttttaatcatcgcggttaaggccggcaccgacagcggcttactcagcacatcgtccataccagcgtccagatactcttttttatctttcagaacgttagccgtaagcgctaccagcggcggtaaatcttcccgcgtgtggcgacgggtcagttctctggcgatatccagacccgtcatatccggtagctgaatatccagtaagaccaggtcgtattctcccggcacgaacatctccagcgccgccttgccggtcatcgcgacatccacgctgttccccagtttttccagtaccgaacgcgccacgatcacgttcagttcaatatcttcgaccagcagaacatgcagcgcgggcagcggcatgtcgtcttcatcaaaggcgtcctccacctcttccgccaccgctggcgcatgaaccgttagcgtaaaggtcgatcctttgcccggcagactggaaacggtaatatcgccgcccatatttttcgccagccgacgggagaccgccagcccgataccggtccccgtcgccggtttgccgccgttactgtctttcacctgataatacatggcgaaaattttatcctgctcatcctgcggaatgccgatcccggaatcttccacttcaaagtgcagcatgtcgccttcatcatagcgcgcccgcaccgtcacctggccctgctgagtaaacttcaccgcattgctgatcaaattccataaaatctggcgcagacgcgttccgtcggtaatgactttgtgcggcaacggcagcgtcggctcaagcacaaaacgtagccctttttgctgcgcctgcaaaccggaaaggttttccagatcggccataaagctggtgaaatcaatgggttggttatcaagctgaaccttacgccgctccatcttatccatatcaatgatatcattgaaaatattgcctaacgtcacggcggagacatggattgtcttaaggtatttttcctgttcggcggtgagatcggtatccagcaggatgcggcttaaaccgacgatgccgttaagcggggtgcgcagctcatgactgatggtagagataaacgtggtcttgtcgcggctggcgcgctccagcgcgtcctgataacgcttacgttcggtaatatcacgaccaaatcccatcaggccatgacgtttaccgacacggtcgtaataaggcactttacgaatttcaaagcaggcctttcgtccgtccgggtaatccagccactgttcgtaggtcagggagacgttatggcggaatactttttcgtcggtttcaatgactttctccgccgcttcgggagagtacacatcttccggcttcaaatgcaccagctgtttttcgctcttgccggttagcaattccattgcgcggttacagccggaaaattctttatcctcattacgataaaaaaccaaatccggcgaggcgtccagaaaggagcgcagaaaagaggattgctgttctagctggatttgcgcttcttcacgctctttaatttctacttttagctgttcaaatgtctcttgcagctccgcttccgctttttcgcgatcggcaatttcctgattaagctgggcaatattgtccttcaactgtacgttaagcttgagatcgcgctcgcgcatctcctccagcttttgcaccagacgcgacagtcgctgccttgactcttccagttgttcaacaacaacggataagaaatagaccgcccagggcgtaattaacaggccaaaaaagatggaacgaataacgtcgatactttcaacctgaccatgcagcaccatggtcaccgccatctgcacgacaatcgccagcaccaccaatgccaacgccaggagcatggaaaagcgcaccagacccaatttcatcatcaggtcgacatagtattgcgccagcatacgaatttgcttcatagaggattccttcaccacaacttcgcacataatacccaattatgggaaccgcgttgaatattgtgcgaaatatgcgtagcgcccctcatcacgctacgctacaggtggtatccagggacgggccagcgcagagccctgtacgccatgctcattcaggtatttgtccagctcaaccatccccgtccagcgattctcgcaccacagcggggcaagcagcgtcggacggcgagcgctggctgaaattcggtgataaattacctccggcggcgtatgacgaatcatctcacctgccgttagcgtgtagtcgtccagttcgatgccgttcagccgccccgcttcccaggctttggccatcgtactgcctttcacaatatgcagcggatgcagtttaataccatcaacgcccgtctccaccacacgctccatggtttgcaggcattctgcctgcccttcgcccggcagccccacaatcagatgcgcacacactttcagcccgcgctcccgggcaatccgggtggtacgctgatagcaggcgaagtcatgcccgcggttaattcggcgcagggttttatcgtgtgcggtttgcaatcccagttccagccacacctcgtagccttgatctttatattcacacagtaaatctactactgcctgcgggacgcaatccggacgcgtaccgacgcataacccgacgatactggcctggctgaccgcctgttgatacatggaacgcagcacctgcacttctgcaaaggtgctggtgtaggcctggaaataggccagatagcgtttagcgcggttcaccagatgcgcctgatgcgcaagctgctcggcaatcgaatgatgctgctgcgcctcatcggcaaaagaggcgacattacagaaggtgcaaccgccacgcccgatggtgccgtcgcgattagggcagctaaaaccgccatgaagcgtcagcttatgaaccttttgcccataccgacgtaaaagatccccaccaaacatattgactaatttctgtaactgcataatctgatagaccgcctcttaaaaagaggccaaagcctgccatttttagtctcctttggcgatgacctggatcaatcgtcccggaaggcttttatccattgcataatcaagcaaaataaacgatatttcattcataatcccgctgatgatttttcctgatattcccctcttttttcagcgtttgctgggtcatcgataaaaacagtagcattcaatactgctcacgcttaaaacagcataaaatgccaagatttttgaaaaagcaaggtcagataatgcctggcgagcggctcttatagtgagacagatcacaggctttctgccgctccgtattagcagcccttctataaaaaaccttttaatttcaaaagattcaaaaagttatctgtgctacagcacacttttgcataaatcagtttgccatttgacctgggtgtggattcccgataagttggggatccgctggaagctttctggatgagccgtctgctcatcatatttatgcagtaattgagattccctcttaaccgtatttaccaatgcgcaaaggacacaaagagggcgaatgcgaggtaagcgtatgatgcgccagccccgtcgccatgctcttgctgtgcccgcgcgccgtcggttgggagagcgtcccgtagagcctggggaggttcactgatatgttgtacgataaatcccttgagaaggataactgtggtttcggcctgatcgcccacatagaaggcgaacctagccacaaggtagtgcgtaccgccatacacgcgctggcccggatgcagcaccgtggcgcgatccttgccgacggtaaaaccggcgacggttgcggcttgctgttacaaaaacctgaccgtttctttcgcatcgtggccgaagagcgcggctggcgcttagccaaaaactacgccgtcgggatgatatttttgaataaagatcctgaactggccgccgcgtcacgccatattgtcgaagaagaattacagcaggaaaccctgtcgattgtcggctggcgcgatgtgccaaccaatgaaggcgtgctcggtgaaatcgccctctcctccctgccgcgtattgagcagatttttgtcaacgctccggcgggctggcgtccgcgtgatatggagcgccgtctgtttatcgcccgccgacgcattgaaaaacgcctgcaggacgacaaagatttctacgtatgcagcctgtcgaacctggtcaacatttataaaggtctatgtatgccggcggatctgccgcgcttctacctggatcttgcggatctgcgtctggaatcggccatctgcctgttccaccagcgcttttccactaacaccgtgccgcgttggccgctggcgcagccgttccgctacctggcgcataacggcgagattaacactatcaccggcaaccgccagtgggcgcgcgcccgtacctataaattccagacgccgctgatcccggatttacagtccgctgcgccgtttgttaacgaaaccggttcggattccagctcgctggacaacatgctggaactgctgctggcaggcgggatggacatcatccgcgccatgcgcctgttggtaccgcccgcctggcagaacaaccccgatatggaccaggatctgcgcgccttctttgactttaactccatgcatatggagccgtgggacggtccggcaggcatcgtgatgtccgacgggcgcttcgccgcctgtaaccttgaccgtaacggcctgcgcccggcacgctatgtcattaccaaagataagctgatcacctgcgcctccgaagtcggtatctgggactatcagccggatgaagtggtcgagaaaggccgcgtcggcccaggcgagctgatggtgatcgacacccgcggcggacgtattctgcattccgcggaaaccgatgacgacctgaaaagccgccatccatataaagagtggatggagaaaaacgtccgccgcctggtgccgtttgaagagctgcctgatgaagaagtcggtagccgcgaactggacgatgacctgctcgccagctatcaaaaacagtttaactacagcgccgaagagctggactcggttatccgcgttttgggcgaaaacggccaggaagccgtcggttcaatgggcgacgataccccctttgccgtgctctccagccagccgcgtattatttacgactacttccgccagcagttcgcgcaggtcactaacccgcctatcgacccgctgcgtgaagcgcacgtcatgtcgctcgccaccagcatcggtcgcgaaatgaacgtcttctgcgaagcggaaggtcaggcccatcgcctgagttttaaatcgccaattctgctgtactccgatttcaaacagctcaccaccatgaaagaggagcattatcgcgctgaccgtctggatatcaccttcgacgtgaccgaaaccacactgaacgcgacggttaaggcgctgtgcgataaagcggaacagatggtgcgcaacggcaccgtgctgctggtcctctcggatcgcaatatcggtaagaatcgcctgccggtccccgcgccgatggcggtgggcgcggtgcaaacgcgtctggtagaacaaagcctgcgctgcgacgccaacatcatcgtagaaaccggaagcgcccgcgatccgcatcactttgcggtactgctcggctttggcgcaacggctatctatccgtacctggcctacgaaacgctggggcgtctgattgatacccaggccatcgccaaaaactaccgtaccgtgatgcagaactaccgtaacggcatcaacaaggggctgtacaagattatgtccaaaatgggcatttcgaccattgcctcttaccgctgctccaaactgtttgaagcggtcggactgcacgatgatgtggtaaacctgtgcttccagggcgtggtcagccgtatcggcggcgcgagctttgatgacttccagcaggatctgctgaatctctccaaacgcgcctggctggcgcgcaaacccattagcccgggcggcctgctgaagtacgtccacggcggcgaatatcacgcctataacccggatgtcgtgcgtaccctgcaacaggcggtacagagcggcgagtacagcgattatcaggaatacgccaaactggtcaatgagcgtccggcgtcaacgctgcgcgatctgctggcgatacatccagacggcgaggcggtgactatcgacgaggttgagcccgccagtgagctgtttaaacgctttgataccgcagccatgtctatcggcgcattaagtccggaagcgcacgaagcgctggcggaagcgatgaacagcctcggcggcaactccaactccggcgaaggcggcgaagacccggcgcgctatggcaccaataaagtgtcgcgcatcaagcaggtggcttccggccgctttggcgtgacgccagcctacctggtcaatgccgatgtgattcagattaaagtcgcgcagggcgcgaaaccgggcgaaggcggtcagttgccgggggataaagtcactccgtatatcgctaaactgcgctattcagtgccgggcgtgacgctgatctccccgccaccgcaccacgatatctactctatcgaggacttagcgcagctcattttcgatctcaagcaggtcaacccgaaggcgatgatctccgtgaagctggtatccgaaccgggcgtcggcaccatcgcgaccggcgtggcgaaagcctatgcggatctgatcactatcgccggctacgacggcggtaccggcgccagcccgctctcttcagtgaaatacgctggttgcccgtgggaactcggacttgttgaaacccagcaggcgctggtcgccaacggtctgcgtcacaagattcgtctgcaggtggacggcggtctgaaaaccggcgtcgacatcattaaagcggcgattctcggtgcggaaagtttcggcttcggcaccggcccgatggtggcgctgggctgtaaatacctgcgtatctgccacctgaataactgcgcaaccggcgtagcaactcaggatgacaagctgcgtaagaaccactatcacggcctgccgttcaaagtgactaactactttgaatttatcgcccgcgaagtgcgcgagctgatggcttcgcttggcgtgacccgcctggtggatttgattggccgcaccgacctgctgaaagagctggagggcttcaccgctaaacagcagaagctggcgctgtctcgtctactggaaaccgctgaacctcatccgggtaaagcgctgtactgcaccgagaataacccgccgtttgataacggcgtgctgaatgcgcaactgttgcagcaggcgaaaccgtttgtcgatgcgcgccagagcaaaaccttctggttcgacatccgcaacaccgatcgttccgtcggcgcgtcgctttccggctacatcgcacagacccacggcgatcaggggctggcttccgatccgattaaagcacacttcagcggtaccgcaggccagagctttggcgtgtggaacgcgggcggcgtagagttatatctgactggcgatgccaacgactatgtcggtaaaggtatggcaggcggtttgattgccatcagaccaccggtaggttccgccttcctcagtcataaagccagcattatcggcaacacctgcctgtatggagccaccggtggccgtctgtacgcggcgggccgcgcgggcgaacgtttcggcgtgcgtaactccggggcgattaccgtagtagagggcatcggcgacaacggctgtgaatacatgaccggcggcatcgtctgcgtgttgggtaaaaccggcgttaacttcggcgcggggatgaccggcggcttcgcctatgtgctggacgaagatggcgaattccgtaaacgcgtgaacccggaactggtagaagtactggacgttgattcgctggctatccacgaagagcatctgcgcggtctgatcaccgagcacgtgcagcatactggttcgcaacgcggcgaagagatcctgtccaggtggtcaagcttctcaacccaattcgcgttagttaagcccaagtccagcgatgtcaaagccctgttgggccaccgtagtcgtagtgcggcagaattgcgcgtgcaggcgcagtaaggaattgaaatgagccagaatgtttatcaatttatcgacctgcagcgcgttgatccgccgaagaaaccgctgaagatccgtaagatcgaatttgttgaaatctacgaaccgttttctgaaggtcaggcgaaagctcaggcggatcgctgtttgtcctgcggtaacccctactgcgagtggaaatgtccggtacataactacatcccgaactggctgaaactggctaacgaagggcgtatttttgaggcggctgagctatcgcaccagaccaacaccctgccggaagtgtgtggccgcgtctgcccgcaggaccgcctgtgcgaaggctcctgtacgctgcacgatgagttcggcgcagtgaccatcggtaacattgagcgctatatcaacgataaagcgttcgaaatgggctggcgcccggatatcaccggcgtgcgccagacggacaaacgggtagcgattatcggcgcaggtccggcagggctggcgtgcgccgacgtgctgacccgcaacggcgtgaaggcggtggtctttgatcgccatccggaaatcggcggcctgctgaccttcggtattccagctttcaaactggaaaaagaggtgatgacccgccgtcgcgagatcttcaccggcatgggtattgagttcaaacttaataccgaagtgggtcgtgatgtacagcttgaagatctgctgaaagattacgatgcggtattccttggcgtcggcacctatcagtcgatgcgcggcgggctggaaaatgaagatgcggacggggttttcgacgctttgccgttcctgatcgccaatacgaagcagatcatggggtttggcgaaaccagcgacgaaccatatgtcagcatggaaggcaaacgcgtggtggtgctgggcggcggcgataccgcaatggactgcgtacgcacttccatacgccagggcgcaacgcacgtaacctgtgcttatcgtcgtgatgaagagaacatgccgggttccagacgcgaagtgaagaacgcgcgcgaggaaggtgtcgaatttcagtttaacgttcaaccgctgggcattgaagtcaatgccaacggcaaagtgagcggcgtaaaaatggtgcgcactgaaatgggcgaaccggatgccaaaggccgtcggcgggcagagatcgtcgccggttccgagcatgtggttccagctgatgcggtggtgatggcatttggttttcgtccacacagcatggaatggctggcgaaacacagcgtggaactggactcgcagggacgaattatcgcgccggaacgcagcgataatgctttccagaccagcaacccgaaaatcttcgccggtggcgacatcgtgcgcggttccgatctggtggtgacggcgattgccgaaggccgtaaggcggctgacgggattatgaactacctcgaagtgtaacccttccggctccccgcttactgccttggctgatggctggggagccgatattcctctcctcaatatctctcctgccgattctggaaacccgctcgtaaatcgagatgtaatgccatgtaaaatccgctcatggattgatccgtttacgcctgaagcgtattgatagcgttctaatttcacaatgaaactatcacgtaagggatgacatgacgaatccaactttagcgccacagtctgatgaatatcagcaaatccataacggaattgttcaactgctggacacagcgcggacacaaaccgttcgcagcatcaacaccatcatgacagcaacctattgggaaatgggtcgacgcattgttgaatttgaacaaggcggtgaagccagagcggcttatggtgaacagctaattgatcgtttatcacaggatttaagccaaagatataaacgaggtttttctgccagtaatctatggcaatttaaaaagttttatctttattttcaaaaaattgagattctccagacagtgtctggagaatctctccatttggcgcaactggctaaatctttcccactcccctggtcggcgtatgtccgcctcttgtcggtaaaaaatcccaatgcccgcactttttacgagaaagagacgctacgtaacggctggtccgtacggcaactcgatcggcaaatcgccactcaattttacgaacgaacgctactgtcccacgacaaatccgccatgttgcagcagcctgcacccgccgagccaaacgttttgccggagcaagccatacgcgacccgttcattctggaatttcttaacctgaaggacgagtattccgaatcagacctcgaagacgcgctgctcagccacctgatggactttatgctggagctcggtgacgattttgcttttgttggccgccaacgccgactacgcatagacgatagctggttccgcgtcgacctgctgttcttccatcgtcgcttgcgctgcctgttgctcgttgacctgaaggtaggcaaattcggttatgcggatgccgggcagatgaatatgtacctgaactatgccaaagagcactggacaatgcccggagaaaacccgccagtcggcttagttttgtgcgcagggaaaggcgcgggggaagcacattacgcgctgactggcctgccaaacaccatcatggcgagcgagtacaaagtgcagttgcccgacgaaaaattactcacagacgaacttattcgttcgcaaaccatgctggaaactcaactcacacgcggtggttcactgacaacggagaaaaactaacgaaccattaatgccatgaataattatcaaaaaaaatatcacacgaaaacgtttgctttattctggaaactgtatattatgcggcggattttttgggcaaaattcatggaggcgttgtgtcgcaggacaacaattatagccagggccccgtccctctggctgcgcggaagggcgtgattccactgacgtttgtcatgttgggtttaacgtttttttccgccagtatgtggaccggagggacactcggcaccggtctttcttataatgatttcttcctcgcagttctcttcggtaatctcctcctcggtatctacactgcatttcttggttacatcggcgcaaaaaccggactctccacccacctccttgcacgttactcctttggcgttaaaggctcatggcttccctcgctactgctaggcggtactcaagtgggctggtttggcgttggcgtagcgatgttcgctattccggtcagtaaagcgacgggcattgatgccaatattctgattgccgtttcgggtctactgatgaccctgaccatttttttcggcatctcggcgctgaccattttgtctatcgttgccgtacccgcgatcgttattctgggcagctactccgtctggctggcggtcagcggcgtgggtgggctggagcatttaaaaacgatagtgccgcagacgccgctggatttttccagcgcgctggcgctggtggtgggctcgtttgtcagcgccggtacattgaccgccgacttcgtccgcttcgggcgtcatgccaaaagcgccgtactgattgcgatggtcgcttttttcctcggcaactcgctgatgtttatctttggcgcggcaggcgctgccgccgtcggtcaggcggatatctctgacgtgatgatagcgcaggggctgctgctgcccgcgattgtggtgcttggcctgaatatctggaccaccaacgataacgcgctgtacgcatcgggtctgggcttcgccaatattaccggtctttccagccgtacgctgtcggtggtgaacgggattatcggtaccgtgtgcgcgctgtggctttacaataattttgtcggctggctgacgttcctgtcatctgccatcccaccgattggcggagtgattattgccgactatctgttgaaccgccgccgctatgccgacttcaacaccgtgcgctttattcccgttaactggattgctattctttccgtcgcgctgggcatcgccgccggacattatgttccgggtattgtgcccgtcaacgccgtactcggcggcgtcttcagctatatcctgctgaatccacttttcaaccgcagccttgctaaatcaccagaggtcagccatgcagaacaataacatcaccattcgtcagacgcgtctgcagggacacgaaggattatggcagattacgattgaaaacgggcgctttagccggattgagcctcaggaagccgcatcgttaccgcagggcgaagtgcttgatgccgaaggcggtctggctattccaccgtttgttgagccacatatccacctggataccacgcaaacggcgggtgaaccgagctggaaccagtccggcacactgtttgaagggattgagcgctgggcagaacgtaaagcaatgctcacgcatgaagatgtgaaagcgcgcgcgatgcagaccctgaaatggcagatggctaacggcatccagtacgttcgtactcacgttgacgtttcagatcctacgctcaccgcgctgaaagccatgctggaagtgaagcaagaggttgcgccgtgggtagacctacaaatcgtcgcctttccgcaagaaggtgttctgtcttatcccaacggtgaagcgctgttagaggaagccgtgcgtttgggcgctgacgttattggcgccattccgcactttgagttcacgcgggaatatggcgttgaatcgctgcacaaaatctttgcactggcgcagaaatacgatcgcttgatcgatgtgcactgcgacgaaattgatgacgagcagtctcgctttgtcgaaacggtcgcggcgctggcgcatcgtgatagcatgggggcgcgcgtgaccgccagccacaccacggctatgcactcgtacaacggcgcgtatgcgtcacgcctgttccgcctgttgaaaatgtcggggattaacttcgtcgccaacccgctggtgaatattcatctgcaagggcggtttgacacttacccgaaacgtcgtggcgtcacgcgggtgaaagagatgctggaagcggggatcaatgtctgctttggccatgatgacgtcttcgacccgtggtatccattaggcaccgccaatatgctgcaggtgctgcatatggggttacacgtttgccagttgatggggtatgggcaaatcaacgacgggttaaatctgatcactatccacagcgcaaaaactttgcacctgcaggactacggtctgagcgtcggcaatgccgcgaatctggttatcttacccgctgagaatggattcgacgcggtacgtcgccagacgcctgcccgttactcgattcgccacgggcgggtaattgccgagacggtgccgagccagacgacgctgcacctgacccagccggaagccgtgacgtttaagcgttaacccgtcatacccgcgctctccggcacattcaccacgcagccccgtaaggggctgcgttcggaagactgctccggcaagagattcaggccgccagcagactggcgcgtactttcactaccactttcttgatgtcatccggctcacccactgcacatcccggtttatgcggttctcccggcataaacacagcaaacatccccgcttgcagcgtaatagtctgctcgtcgacaatttgactacaaagctggtaatcctcttcaacgtgcatctcctcgcactggcgagcggcaccggacatcccaaacgcaatacgctcgacgccggttagtagtagctgaatatcaatgtattgttcatgcaattccgctttcttctcggccggcatttgcgtcgttaactgcattacattcataaagacattgtcgccctgcaattcatagcgccccggcgctttctcctgcggccttgccgccagcgcgagagtcaaggcatccaacaatcgcggatgcaacccgcaagaaggcaacgactgtacttcccccatcatcataatgtgtctccttgagctaacaacgcagcgcctaataatcctgcgtcatgccgatagcgagcggcgctcagcgccacgtgataaggcgcaggctcttgcatcaaaaacgcgcgaacctgctccaggtatccctcagctaaccctacgctgccgccaatgaccacacactggcagtcggtagtcgctttcacatcggcgatcattcgcgctattacctgcgcggattggcttaccagatgtcgcgcctgctgatgaccttcgccagcgcgaataaatagggttttggcgtcgcatcccgccagatcgtcccgcgccgccgcggccatccctcgtccggaggcgatggcctctacacaaccaacgcgtccacagccgcatacgggcccgtgtgggtccgccagggtgtgtcccaggtgcccggccagaccgccttttccggtaaggagcttgccgtcgcagacaacgccgccgccaacgccggttgaaacggtgataaataccatatcgcggatatcatcagggagcgcgtgatactccgcccaggccgccgcctgcgcgtcgttcaccgccagcgtcggcaggccagcgatcgcttccagtgtttgtactaacggaaagtgtagcaagccgcccagattatgggggtttagcgccagcagcatcccttcctgaatgatcccggtagaagctatcgctacctgacgcgcctctgctcgtagtggttcaaccagcgcctttaatgcttcacgtaacgcatccggcgttttgctcgcgggggtcggtagctcgcgacgctggctaatgcgcaagttgttgtcgatgagcgcggcggcaagtttagtaccgccaatatcgattgctaacgtagtcatgacgccgccttttttaatgcgtcgttataccatccacagatatgttccagacgggtaatggcggaccccaccgtcaccgcccatgcgccatagcggatcgcctccgccgccagtgctggcgagttatagcgcccttcggctattacccggcatccggcgtcatgcaacgctttgactaagggcagatcgggttcctccggcgtatcgggggtggtgtagccggacattgtcgtgccgataatgtccgcgcccaaccgttggcaggcgagaccatcgtccacggatgagcagtcggccatcgccagtagatggtggtgatgaatgcgcgccaacaacgcctcaacggctaccggccgttgccgagcggttccatcaacggcgataatagctgcgccggcctgcgccagcgcatctacatcgtcgagaaaaggggtaatgcgcactggagactcatccagatcgcgtttgataatgccgataatgggtaccgaaacgagcgagcgggtcatacgcaggttgtctatgccttcaatacgcaccgcaaccgcgcccgcctgttccgctgccaacgccattgccgctacaatctccggcttatccagcgggctgcccggaacgggctggcaggagacaatcaggccgccagaagcggcaatatttttatccagttgttcaagtaacgacatactactcccttacaaatattgcccggttgaaaaccgggcaagcggattaacttttcgtttttacaaaggcacctttaccactgccaagcggtacggctccgctgaacggtttgtcgtcgatagcatcatgggtgcgtaacgcttccggacgtagccaacgctgtacgcgagacggcatatcaagcccaataagcaggatcacgacaaacgtcaggctgaaagagagcgatgccagcgcagtgcccagatccagacgttgagcgatcagcgctcccaggatcggcgccagcgcgccgccgagcgcgccgacgttataagtaaagcccagccccgccgcgcgctgatcggtatcgaagtaaccgccgatcagtttcggcagaatcccggcaatcccctgccccaacatctgttggaaaaacagtagcagacccagaacccagacgtttgtgccgccaatcgcaaagaccggaataatgaggatttgcgaggccagcaggctacagacatatgctttacgcgttcccagccagtcgccaagaaaaccgcctacgcagcaaccaaccgccgcgccaaatccgctaaagaacaggacattcgccaccgtatgcggatcgtaggccagctcggttttcagataagtgggtaatagcgcctgaatcggccaggaatagaggaaagcaaacagtaccaccagcatcagcatgacgccagtgggccagcgtttaccgctgctctgcaccataaagctgataaagataaccgcgcacagtagtcccagccccgccacaatcgcagcattttgtaggttaccggcaaaacagaaccacagcgcagcggcggcggcgaaagtcattaaaatgttgatgatgcgatgttcgccccgataaagaatgtcgaccatcgtacgtaccggcgctttacccgcgtgtttctctttccagtcttccgcttccggaatgtttttccgcagccagagagcgaagataattggcaaaatgccaatgaaaaacagcgcgcgccagccccagacaggcaccaccaggctgtacacctgcgcggcaacgaccgcgccgacggagaagccggaaatcagaaaaccgctggctttattgcgtaaatgttttggccagctttcaatcacataggtcgcgctggaaccatattcgcccgccatgcccataccaatcaccagtcgggcgatgaacatggtggtgtaaccgggcgcaaacccgcatgccagggttcccaccgaaaacagaatgatgctgctgaccatcgccagacgacgcccatagcgatcgcccatcgcgcccagtaataacccgccgaaccagcgagagataaaagccgcagaaatcaggcttgccgcctgtaccgtcgtcagcccaaattcgctttgtacctcagtcagtacaagagcaatcaacacaaaatcaaaaccatcaagcagatatcccagccaggcagcggaaaatgcccgccactgcgcccggttgagatggcgataccacgggatgttctgggtagaagtactcattttactctcccgacgatttttgttgtcgttatgccgaatggcggctccgccttatccggcctaccgctcacactgttgtaggccgggcaagcgtagcgcccccggcattatgctgttacgccttttcttccatcagttgttgagccagcgccttgagcgccggcaggtatttttcatcaacaggcgcgaacggtttacgacacagcggcaccgataccacgtccatataatgcaggaccgttttcaggccgcggaatacgccggttttaatcagtaaatcaataaccttattgcactcggtttgcagacgctgcgctttcgccacatcgccctcacgtaatgcctgcacaatcccctggtaacgccagcccataatgttgtatgtgctgccgataccgccgtccgcgcccgccagcaggccggaagcgaagatttcgtcataaccgttgtacagcaccagatccggatgcgcgcggcggatctgctccatctggaagagatcgccggaggtttgcttcagcgcgctcacgcccggtaatgtcaccagcgtattgatctgatcgagggtaagttttacaccgcttaacgccggaatgttgtataccaccatcggcaatccatctgcggaatcaatgattgcccgataatggtcacagtgctcttcaaaactgaaagggtaataaaaaggcgtcaccgcagagaccgcatcaaaaccgtaacgctttgcggcgctggcaagctgctggctttctgcggtgcttactgtcccgacatgggcgatcaacgtgatttttcccttcgcctcttcggcgacaatctccagtacctgctctctttcagcaaggctctgtacgaatgcttccccggtggaaccgccaacgtacagcccgtcgataccctgcccgatgttaaaacgcaccagacggcgcaggctttcgctatccagttgctgctgatgatcaaatggggtcaacaacgccgccattacgccttgcaatgcttttgccatacctacctctacggatgatgaatatattaactacctacctttatacctgttataccagatcaaataagcagcaaataatacagaacgcttatagtgcgatctgcttcactaaaccgggatcggaggtgcgatcgctaccgcattttttgactttttttaccgagcgcgtgccaggtagcggaaacgctattgaggtgggtttgcagagcgcgatccgctttatcgggatctcgctggcgaatggcatcaacaatcacaatatgttgttgataactcacgttattatgttcatgcagctcacgatcgggaacgcttgggcgagcggcgattagccagtccagcagagcaacatgaatagccataaagatcggattgccgggaatttcagccagcacccggtgaaactcgacatctgaacgaataaacagcgcgttgtcatccagcgactggctattaatttccagcgctttcgttaacaacgcgatctgctcgtcggtagcatgttccgccgcatagcgtaccaggctggattcaaagaaaagccgtagctgttcaaagtgagcgatgccgccaggatgagtaagaaaatctttcgccatacccgacagttcactgatgatggtatcagcggaggggcgcgagacgcgggcgcgttcgccgttattgatttgcaccagacctttacgcttcagcgcagctaacgcttcacgcacggagggacgtcccacattgaagaaggccattaattcacgttcagacggtagctgttctccctcgccaaactcatgacggcggatcatctgctccagctcttcctcaaccatttcagacagttttttacgcgccagcgggcggcggcgcaaactacgcccgagggatgtcggagaatcttctgcttgcgaatcaaatgcgttcataacgtccattcatgagtggtcggtggcaaataatagcaagcttatcgtaacacagctttaaaagcagggtgaacccgagaggagaccaaacaaaacaggcccttcagggcctgttgattattttactacacgcagcgccggacgtccgccacgcggcggaggcggctcgtcatcaggactactgtcgtcatcgtggtcgggcttatcaccatcaatgacggacatcacggtctcgctttccgcgcctgcggtattgtcatcatcatttaagctgacaacgtcttcatcataggcggcttcaggctcaaacatggtgcctgcgccattttcacgggcgtaaatcgccagcaccgcagccaaaggcacagaaacctgacggggaacgccgccgaagcgcgcattaaaacgcacttcatcattagacagctccagattacctaccgctcgcggcgcaatattgaggacgatttgcccatcgcgcgcatattccatagggacatgcacgccaggcagcatcacatccaccaccagatgcggggtcaactggttatccagcaaccactcgtagaaagcacgcaacagataaggacgacgcggcgtcaactgtgacaaatccatacaggttaaccccgaccgaggcgcatttcacgttcagcttcggttaaagaagccaggaaagaatcacgttcaaagacgcgggtcatatagcctttcagctctttcgcccctgcgccgctgaattcaatacccaactgcggtaaacgccacaggagaggcgccaggtagcaatcaaccaggctgaattcgtcgctcaggaaatacggtttctgaccaaatactggcgcaatcgccagcagctcttcacgcagttgtttacgtgcagagtcggcctcggaagcagacccgtttacgatgacgttcatcagcgtataccagtctttttcaatacggtgcatgtacagacggctttcaccgcgcgcgaccggataaaccggcatcagcggcggatgagggaaacgctcatccagatattccataatgatgcgagattcccacagggtcagctcacgatccaccagtgtcggaacgctttgattcgggttgaggtcaatcagatcctgaggtggattgtccttttccacatgttcgatctcaaaactaacacccttttcagccaacacaatgcggacctgatggctatagatgtcagtaggaccagaaaacagcgtcattaccgaacgtttgttggcagcgacagccatgaaaacctccaggtatattcagaatttttactgctaccagccacaatgtgaccagccagatgttatgtcacccagggcgaaaaaagccatcattgctcagaaacgagacaaaaaatgaacattccccgctatttgggcagaaaattggatgatagtttaccagattttgtgacctttgtggtgagtcgattctggaaatgaggaaaaagagatattcctggtctgaaatgctcgccccacctgagatattgtctttcgcctgttatgcctgtactaccggtgcgccccagccatcaaaactgccgccatgtttttcagccagatcggtaagctggcaagtgatttctgtcatatgccattgttgcggagcatcggtgctgataaaagacgccataaacccctgttgcgggtcattcattcgaatactgaccagcgttatgccatacggtaatgcagcaatatcttgcgccaggtcgcgcgctgcgacctctgtaggcaatgtcgcataataatcaatagcgcgcggaagcgtcagatcatcaccttgttcctgtaatccccggcacacacgggaatcgtgtatccagttccagtcgtatcgggttggatacaagaactggcggtaaaagtttcctttatcattgtgactctctctataactaaaagagatttccgggccaccagcgagcaatttatccagcgtcttttcccagttaagatcctcttccgacatgaacacaaaatcgcgccagccttgttgggtaaccacacccaccagccagatcggaaacgtcttccccttttcatcaagccagtcctctatacgatttaaactctgtgtttcatcgggctgcggtaaaccattttcataacagttggtgtaatgaacacgtaagaacccggtatggataaggcgatcaaatttttcatcctgaatggcgccgatatccacacgtatacccgtaacatggtcatccaccgttgttataaagaattcccatttattcgacagcattaacgactctttcttagtaaacaatgagttaaaaaatcccactgtgacttccttttctctgagcgtgcatgaaaaatgaataagatgagaataatgctaaagatagggaggaaaagagactggattcggactttagccataaaaaaacccgccgaagcgggttttttcgctaacagttgtctgccgaagcagaaccccattaacgtttggagaactgcggacgacgacgtgctttacgcaggccgactttcttacgttcaacctgacgagcgtcacgagtaacgaagccagctttacgcagttcgccacgcagggactcgtcgtactccatcagagcgcgggtgataccgtgacggatcgcaccagcctgaccagagataccaccacctttaacagtgatgtacagatccagtttctcaaccatgtcgaccagttccagcggctgacgaactaccatgcgggcagtttcacgaccgaagtactgttccagagaacgttggttgataacgattttaccgttgcccggtttgatgaacacgcgagctgcggaacttttgcggcgaccagtgccgtagtattgattttcagccattgcctataatcccgattagatgtcaagaacttgcggttgctgtgccgcgtggttgtgctcgttgcccgcgtaaactttcagtttacggaacatagcacgacccagcgggccttttggcagcatgcctttaaccgcgatttcaatcacacgctcaggacggcgggcaatcatctcttcaaaggtcgcttgtttgataccaccgatgtggccggtgtggtgatagtacactttgtcagtacgcttgttgccggttacagcaactttgtcagcgttcagaacgatgatgtaatcaccggtatctacgtgcggagtgtattccgctttgtgcttaccgcgcaggcgacgagccagttcagtagccagacggcccagagttttaccggtcgcgtcaacaacataccagtcgcgttttacggtttctggtttagctgtaaaagttttcattaaaagcttacccaaataaataagttacacgttggtgaacacccaaacgttttaaatagttgaggttcacacgacaaagtccggtaaacctaccccctcggatatgtttggccggcacagagaaagtttgggaaaaaactctcttgtaacgtggggtcgcaggattatagagaagtccaggtcaaagatcgacccctttttgcgatttgccgcgggttttgttcaggcctggttcaccctccggtcggggaggttgcacagatataataccgcataatgccggagcgctgcgcttgtccggcttacggcatatgctcccgcttgagatactccgcactctgcatctcttgcaggcgcgacagacagcgctgaaattcaaacttgagccgctccccctgataaatttcatataacggcgcggcagcgctgaccaccagcttaacgtggcgctcgtaaaactcatccaccagcgcaataaagcggcgcgcttcgttctccatcagcggcgtcatgaccggcacgtcaaacagcagaaccgtgtgaaataaccttgagagcgcaatgtaatcatgctggctgcgggcctcgacgcacagcgtagcgaaagagaccgctagcgtttggttttcaacgcccagggtggataaagagcgatgattgatttccagcgtcggagcgtgctcgcgcgcggcccccgctaacgccagccacagtttatccatttgccgccgggtttcatcattaagcggcgttagccataaatgggcctgcgtcagcgtccgcagccggtaatcgacgccggcgtccacattcataatgtcgcagtgctgtttaatggcatcgatagccggcaggaagcgggcgcgttgcaaaccgttgcggtagagttcatccggcggaatattggaggtcgcgaccagcgtaatgccgcgtgcaaacagcgctttcattaaaccgcccagcagcatggcgtcggtaatatcggtgacgaaaaactcatcgaaacacagtacgtccgtctcggttttaaaccgatcggcaataatgtctaacggatcgatctgtccctgtaacgcggtaagctcttcatgcacgcgcagcataaaccgatgaaaatgcaggcgtagttttcgctcgcccggcaggctgtggtagaagagatccatgagccaggttttgccgcgacccacgcccccccacatatacagcccgcgaaccggtatttgcgcgtccggttcgtttttgcctaataatttccccagtcgcgctatcagaccgccgggtggcgtagccgacgattttttcgcggtgagcgcctgataaagggtttccagacggtcgaccgcctctttctgtacgtcgtcaggctgatgggtgccttcgttgagtgcctggagataacgcgatgtaggggaaaggctttgcataatgttattgttattccttgaaaatcgatgtgccgtcgttcacggctgacgaaaaaaaggccgttctacactacgcgatatgctgtcgggattccacttctacggaattagcggttatagtggcataatcaggcgcgggcatggagcctggagccaacaccctacggaaacataagacaacgggagatgttcatgacctgggaatatgcgctaattggattagtcgtcggtatcatcattggtgccgtggccatgcgttttggtaatcgtaagttacgtcaacagcaggcattgcagtacgaactggaaaaaaacaaagctgagctggaagagtaccgtgaagagctggttagccactttgcccgcagcgcggaactgctggataccatggcgcatgattaccgccagctgtatcagcatatggcgaaaagctccagcagcctgctgccggaaatgtctgcggagtcgaatccgttccgtaaccgtctggcggagtctgaggcgagcaacgatcaggcgccagtacaaatgccacgtgattattctgaaggcgcgtctggcctgttacgtagcggcgcaaagcgcgattaatcgcacgccgttaagaaatttatcgggcgcatcgcttgcgccctctctctatctttcctgtcccagctattatcattgttaccaggctgaaaattcaataacatcaatctgttttgaattgtctatccgttcattcaaggtacgagagcagcatccatgaaaaaacacacccagctgttaagtgcattagcgttaagtgtcgggttaactctttcggcgccgtttccagcccttgcatcgataccaggccaggtgccaggccaggcgacgctgccaagccttgcccctatgctggagaaagtgctgcctgctgtcgtcagcgtaaaagtcgagggaaccgccgcccagagccaaaaagtgccggaggagtttaaaaaattctttggcgaggatctgccagaccagccgtcccagccgtttgaaggactcggttcgggggtgattatcgatgccgcgaaaggctatgtattaaccaataatcatgtgattaatcaggcacagaagatcagcattcaactgaatgacggacgcgaattcgacgcgaagcagatcggcggcgacgaccagagcgatatcgctctgttacaaattcagaatcccagcaagttaacgcaaattgccatcgccgattccgacaaactccgcgtcggcgatttcgccgtggcggtcggtaatccgtttggtcttggacaaaccgccacctccgggattatttcagcgctgggacgcagcgggcttaatctggaagggcttgagaactttattcaaaccgatgcctctattaaccgcggcaactccggcggcgcgctgcttaacctgaacggcgagctgatcgggattaataccgcgatcctcgcgccagggggcgggagcatcggcattggctttgctattccttccaatatggcgcagacgctggcgcagcagttgattcagttcggcgaaatcaaacgcggattgctgggaattaaaggcactgaaatgaccgctgatatcgccaaggcattcaaactgaacgttcagcgtggcgcttttgtcagcgaggttttacccaattcaggttcggcgaaggccggggtgaaatccggagacgtgattatcagtcttaacggtaagcagctgaatagctttgccgaactgcgttcacgtatcgccaccaccgaaccgggcacgaaagtgaagctgggcctgctgcgcgatggtaagccgctggaggtggaagtcacgctggattccaatacctcttcttccgccagcgccgaaatgatcgccccggcgttgcaaggcgcaacgttgagcgacggccaactgaaagacgggacgaaaggcgttaaggttgatagcgtcgaaaaaagcagtcctgccgcgcaggccggtttgcaaaaagatgatgttatcatcggcgttaatcgcgatcgcatcagttctatcgccgaaatgcgcaaagtgatggcggcaaaaccgtccatcattgctcttcaggtagtacgcggcaacgagaacatttatctattgctgcgctaatcctgtcttaaaccgggcatcagcctgcgatgtgatgtccggttaactcatggtatgctgctgccgttcccttttttaacgacgcctccatcatgtttgtgaagctcttacgttcggtcgcaataggtttaattgtcggcgctattctgttggccgtgatgccttctttgcgcaaaattaatcctatcgccgtcccgcaattcgacagtaccgatgagacgccagccagttataattttgcggttcgccgcgccgcgcctgccgtcgtcaatgtctataaccgcagtatgaacagtaccgcgcataatcaactggagatccgcacgctgggttccggcgtgatcatggatcaacgcggttatattattaccaacaaacacgtgattaacgatgccgatcagattatcgtcgcgctacaggatggccgcgtctttgaagcgctactggttggctccgattcgcttaccgatctggcggtgctgaagatcaacgccactggcgggctgcctaccatcccgattaatacaaagcgtacaccgcatattggcgacgtcgtactggctatcggcaacccatataatctgggacagaccatcacccaggggatcatcagcgcaacgggtcgtatcggcctgaacccgacggggcgacagaattttctccagaccgacgcctcgattaaccacggtaattccggcggcgcgctggtcaactcgttaggcgaactgatggggatcaacaccctctcttttgataagagtaacgatggcgaaacgccggaaggccttggttttgcgattcccttccagctagccacgaaaattatggataagcttatccgcgacggtcgcgtgattcgcggctatatcggtattggcggacgagaaatcgcgccgctgcacgcgcagcagggtagcggcatggacccgattcagggcattgtcgttaatgaagtgacgccaaacggccccgccgcgcttgccggtattcaggttaatgatttgattatttcggtcaataataaacccgccgtgtccgcgctggagacgatggatcaggtggcggaaatccgcccgggctccgtcattccggtcgtggtaatgcgggatgataagcagctcacgttccaggtgacggtgcaggaatacccggcgtcgaactaaaacgacgcggcttttgcccgcgtcgttcgacgactagtcaataaagactggccctgccggaaaatgcgccaggaaactcgtgaagatcagcagagcggggagacttttctccccgacggcttcttcacgcagcgccttatccagtacaagcaggctatgctcccccccttcccccaaaatgccgcccatccagagcagtcgttgcgcctgttgacgcgcatactgcgatgcgcttttccaggcgaccagatgcagcaacgtttgtaacagcaggacccgagacgcgtgaccatcgcgttgcaatcgcctgaatacgggtaatgcaatactacgtaccgtcgagaaaccgctcgccgcctccccctcaatcggcgataaaccaacagccgcctgtttgacgaaatcgcataactgattgtgtgttaatggccgctcgcctgcgctcatataccctgcggcaaaacagagtaacccgataccctgagcccaatcggttgatggcagaatcccctgcggaacattcggtgccgacgtctgtgcggcacaaagcccctcgtcgtaacactgtgcaaaacgttgctcatatattgctgagttgacgccagaccacggcagtaaatgcagcgctggctcaagctcagttatctgattcaccgtctcaacaacataatgcaagatggtttctctggatggcatggatgtaccttgccgaaacgcaaccatttcactcattactgtgtcctcattttgcgggaacagaatcactgctcccgattagattggattacatcgccagcacgtacttgagcatcacgcccgccgcaatggccgagccaatcaccccggccacgttcggccccatcgcgtgcatcagcaggaagttctgcgcgtctgattccaggcccactttgttcgatacgcgtgccgccatcggcaccgccgacacccccgccgaaccgataagcgggttgattttgttcttactgcacaggttcagcagcttcgccatcagcaccccggccgccgtcccaatcccgaacgcaatcacacccagcagcagaatgcccagcgtctgcggctgcaggaacttgtccgcgaccagcttcgcgcccaccgacagcccgaggaagatggtgacgatattaatcagcccgttctgtaccgtgtcgctcagacgctccaccacgccgctttcgcgcatcaggttgccaaaacagaacatccccagcagcggcgccgcgtccggcagcagcagggccaccagcatgagcagcaccaccgggaagaggattttttcccgcttactcaccgtgcgcagctgcaccatgcggattttccgctccgtctcgctggtcagcgccttcataatcggcggctggattaacggcaccagcgccatatacgagtacgccgccaccgcgatggcccccagcagctccggcgccagcttgcccgacagataaatcgccgtcgggccgtccgcgccgccgataatgccgatggccgccgcctgcggcagggtgaagctgataaggccgaagtagttcagcgtcagcgcccccagcacggtggcgaagataccgaactgcgccgccgcgccgagcagcagggtgcgcgggttggccagcagcgggccgaagtcggtcatcgcgccgacgcccatgaagatgaccagcggcgcgacaccggagccaatcgccactttgtagaacagcgccagcacccccggcgtgtagcccatgtccaccgccagattttccatctggttctggacggagggcagcgccagcgctaatgcttccttaatggcatgcacgtccggcgcgcagtggagcttcgcggcaatcaccgccagctgtccggcgtcgtggtgcgccagcaggctttccagcgcggtcagcgccagcccggcctccggaatgttcgacagcagcccgccgaagcctatcggcagcagcagtaacggctcgaacttcttcgcaatcgccagccacagcagcagcaggctgaccagcagcatgatggcctggcctgcgccaaggtgcatcagccccatgccctgaagcagggcgttcagactttccatttcagttctccgttacgccagcgtcatcagggtgtcgccgacggagaccgcgtccccggacttcaccgcgataccgcgtaccgtcccggcctgcgcggcgcggatttcggtttccatcttcatggcttccagaatcagcagcacgtcgccttcggccaccgtctggccctcggtggcaatcaccttccagatattccccgccagcggcgcggtgaccggggtgccggcgcctgccggggcggcagcctgaaccggtgcggaagaggccgccggaacagccgcagtgagctggctgatatcgccgccgtcgctgaccttcaccacaaaggctttgccttccacttccacggtgtagataccggaggcggcaggcttctctgcttttgccaccggctgcgcggcttccgcctgcggcagtggctcaaacgccgccgggttattgcggttctcaaggaatttgaggccgatttgcgggaacagcgccacggtgagcacgtcgtcgatggcgtttcccgccagagtaatccccttctcctgcgcctggcgcctgacgtccgcttccagttcagccagctccggtttgagtaaatccgccggacggcaggtcaccggggcgcccccttccagcacgcgggcctgtaacgcggcgttcaccggcaccggggtgtggccgtattcgcctttcagaatgcccgccgtttctttggcaatggttttgtagcgctcgccggtcaggacgttgagcaccgcctgggtgccgacaatctgcgaggttggggtcaccagcgggataaagccgaggtcctcgcgcacgcgggggatttccgccagcacctggtcgagtttgtccgccgcgttctgctgcttcagctggctttcgaggttggtgagcattccgcccggtacctgggccaccagaatacggctgtcgtagcccttcagctggccttcaaaggcgtgatactttttgcgcacctcgcggaagtacgcggcgatattttccagcttcaggatatccagcccggtgtcgtgttccgtgccggcaagcgttgccaccagcgcttcggtggccgggtggccgtaggtggcgctcatggaggaaatcgccgtgtccacgccgtcgacgcccgcctcgatagccttcagcagggccatctccgccatcccggtggtggcgtgacagtgcaggtgcaggcgcacctcaaaacgttttttgatttcgctgaccagctcatacgccgccatcggtgtgagaatgccggacatatccttgatggcaatcgagtcaacgccggtttccagcagttgctccgttaaatccagccaggtctgcagggtgtgcgccgggctggtggtgtaactcagggtcccctgggcgtgcgcgccgtggctgcgcaccgcctgtaatgcggctttcatattgcgcgggtcgttcatggcatcgaagacgcggaacacatccatgccgtttttcaccgcgcgttcgacgaagcgctccaccacgtcatcggcgtagtggcggtagccgagcaggttctggccgcgcagcaacatctgcagcggggttttgggcatggcttttttgagttcgcgcaggcgcagccacgggtcttcgccgagaaagcggatacaggcgtcaaaggtggcgccgccccagcactccagcgacccgtagcccacgtcatcgagcgcggcggcaatcggcagcatgtcatcaaggcgcaggcgggtggcgaacagagactggtgagcgtcacgcaggacgacatcggtaatggcaatggtcatggatccctccgggaattaagcattaaggcggtgatggtggtggatagcggcggcaatgaccggctttaagcgggtgaagtcgtccacgacgggcgcggcggcggcaggtgccgccttcggcgccggagccggttcagggaagaagcggttgacggcggcggacatgccgcggatggcgaaaatcagcaggaacagaaacgccagcacgaaccccatgccgaggaacatcagggtgaagccttcacctaatagcagagctgcattagtcataaaatagccttcaggcaggaggcacgataatggggctatttatgacgatgaaataataagggtggatttccctgagccgccccggccagagcccttggttattattatcgtcataacgtattaccaccattatcgtgcaatttacgtaatcaggtttatttgatgaaacttacgttctggcatatttcatcagcgacgatctctttacgctgattaaaaataattttgttctgttcaaacagattattcccatgggtatcaatagaaacaatcagcgggccaaactctttaacccgacagacccacagcgtttccggcatccccagatcgcgccattgggcatcttcaatttcttccacgcacacggcggctacaaccgcacaaccggcagggaatacgcagtgcagcgctttgtgttcagcacagccctcttcggtacctttacccataccgcctttacccacaattaatttcacgccagtctgcgcaataaactctttttcgaatttctccatacgcatgctggtggttgggccaacggagaccatttcaaacttatcgtcttcgcctttaattgggcggacaatggggccagcgtgtaaaatagcgccgccgcgaacatctaccggaagttcgcgaccaccttcaattaaacggcgatgggctacgtcacggcaggtaacaatatgaccgttgagataaataatatcgccagccttaatatccgctaaatcttcatctttaattggcgtagtcaggatttttttagtcatcagaaattcactccgctgtgagacgtaatggtgtaattcaaatctttatcgaaaacgatatgccctttacggtgcgaccagcagccgacgtttaccgccacgccgatggtagaaggatgacgcgcggtgttttcaatgttcacgcccataacggaggtattaccggacatcccctgcggccccaggccaattttgttaatgccgtcttccagcattttttccagcgaggctgcacgctcattctcgttatgcgaaccgatcggacgcatcagcgcttttttcgatagcagtgccgccgtttcaacagaggtcgctacgcccacgccaaccagcagcggcggacaagcgttgaggccgtagctggtcatcacatccagtacaaagcgggtcacaccttcatagcctgcacccggcatcagcaccatcgctttccccggcagagaacaaccaccgcccgccatataggtataaatgctgcactgatcggaattgggaacgatttcccagaagaccgtcggcgtacctttacccacgtttttaccggtgttgtattcatcaaaagtttctacgctgttgtggcgcagcggagaatctacagttgctttgatcaccgcctcacgcaacaacgcttccagctcgccaatcagcggaaagttcgtcccgcactccaccagaaactgaatgacaccggtgtcctggcaggaaggtcgatccagctctttcgccagacgctggttctcaatcatggtagtaaagatgacgtcggccagtttactggtctctttcttatgcaaatcttccagttttgcagtgacatcatcaggcaaaactttgccggtatatcccacaaacttggccataacgtcggtcatatgggatatctgttcacttttgctcataaatgctccttagtcagaacagcttccgttaattacggatgaaaagggaaaaggattggcagcaggatcaagctgacaatggttgaaacgataatcagggggataccggccttagcgtagtcgacaaatttatagccacccgcggagagcaccatcatgttggcaggcataccgataggggttgcgtaggcgcaggaaccgccaatgaccgtcgccatcagaaccgcacgcgggtcggcccccatgcctgcggcaatggacaaactcaccggcaccaatagcgctgtcgttgcggtattggacataaagttggtcatcacaacggataaggcgaaaacggcgatcagcaacatgaacggtgaggagttttgccccagcatgccgattacatagtccgcaaccagcttgcctgccccggtcatttccagcgcttttgccagcgccagggtgccgccaaagataaaaatagtctgtgaatcaatagctttataggcctgtttttccgtgagtacgccgcttactaccagcacaagagcgccaatacaaccggtcacggccaggctgacaccgatcttcttctcaaagatcatgccgaggatcgttgcgatcaacaccacgagtgagagccgttgtttccactgtggaacatggctgtagtcacgttgcaccccgacgctccccacctcaccgccggtcgcattattcggcagaaagcgatagccaatagtcaggaagtagagaatgccgcagatgagcatcgggagaccgatttttgcgtattcaaaaaagccaaagccgccgccaatattctgtagcgcagactgcgcgataagatttcccggcgcgccaattaacgacaggttaccgcccaacgcagcggcaaaaaccagcggcatcagtagacgagaacgcgagaagcccgattttgccgccacgccgatcaccaccggaatcaaaaccgcagcggtaccggtgttagagaggacgccagacatcaaacccaccaccaccataatggtgaagatcagctgtttttctgttttcgcgaagcgcgtgatgacgccgcccactttgtttgccataccggtctcgaacaacgcaccgcccacgataaacatcgcgacaaagaggatgacgttagtgtcgataaagccagcaaaggcctgtttgatattcagaacgccggtgataactaaggccacgcagacaatcatggaagtgacggccagtggcactttttcccatacaaacatgacgatagcgaacaccaataaacataaggtaagggtaatgggttccatatttataattatccaatcaatgatatatgatattgtatccaatgttggcagggagaaattattcccatacaaaaactaagtcaaatcgtttctcaggaaagatgcaggagtgggatctacatcaagatcgtggttagatcgttactggacgtgattaatagaattgaagaattggttgaagcgcctgcgatgctcacgcaggcgaaaagatcaggcagaagggtcaccaacatagcgggtcagcatattctccattgagcgaataatgtgttcgcgcatgcgctggcgtgccaatgtttcatcatgaagttcaagagcttgcagaatacttttatgttcctgaatggaaatcacggcatactcttcttcggtgaccttatggcccatcgacaggccgttccacatattacagagcaacattttcattttttcgttgccagcaacattccatatttccatatgaaatgcctgattcaggtcggagtattccgccgagttattttccgcgagagccttttcagcggcataatgcacctgggctatccgcgagatatcggagccaggacgagaagctttagccaccgcctcactttctaacagcgcgcgaatttcatagtgttcacggatcgtttgttcattgatgcccaacaccaccgcccctttattagggcgcacttttatcagcccatccgccgccagaatctgaaacgcctcgcgcactggcatactggacacgccgaccattccggcaatgccttctaacgtaatctcctgcccttccactaactccctcgaaagaatcgctttacgcagcactgccgcgacctgttctttcgctgaaagaagcttaatcttccctaacttaggcttctgcactttcccaatccttcatatgttgacgcattatttctgctaaagagaggaaataacgctgcataacttgcccaatctcatcacgccgcccctggcgtatgacgtcagccagttcagcgaaaagctgcgccgactcctgattatcttttttcagatgcaaaataacataagagacataaccgtccaggaactgctgatacaccttttccagatagcggttattcacataagaaatcagcatcgcatgacactccagttcgcaggatttgtcttctgcgacagccagcgcttgcgcacgtatcaggagggcatcgcctacttcgctgggtatcagcgaaaacatttcggcggccatcgcggcaatcacgcgaaaaatatgactcacgcgatcggcctcaagatgcgcgacctgcatgtgcctgttgggcagtcggattaaaaaaccttcctgttcgagtgactgtagcgcttctcgaaccggcattcgtgaaagaccgagctgctccgcaatactttcctgcgcgagttcttctcccgcttttatattgccggaaagaatttcatagcgaagcatttgcgtaatgtgatcgcgggtttgcgttctttggatctttttcacgacgttctcgttaataaccgataagacgtgaggagtttagcagatttagtgcttgatttcgtggcttgtttacagtcaaagaagccggagcaaaagccccggcatcgggcaggaacagcttatttattaataaaatcttcacccaactgaatatcttttttcagcgtatccagcatagcgtccagcgaatgttgctcgaaagcgctcagtgtgccgatggatttacgctcttctacgccgtttttacccagcagcagcggctgagagaagaaacgggcatactgaccgtcgccttccacataggcgcattccaccacgcccttctcgccctgcagagcgcgaaccagagaaagaccgaaacgcgcggcagcctggcccatagagagggttgccgatccgccgccggctttcgcctcgacgacttcagtaccggcgttctgaatacgtttagtcagctcggccgcttcttgttcggtaaaacttacgcctggaatctgcgacagcagcggcagaatcgtcacgccggagtgcccgccaatcaccggcacttcaacttccgttggcagcttacctttcagctctgcaacaaaggtattagagcggatgatatccagcgtggtaacgccaaacagtttgtttttgtcgtatacgcctgcttttttcagcacttccgccgcaatcgcaacggtggtgttcaccgggttggtgataatgcccacgcacgctttcgggcaggttttagcgatctgctgcaccaggtttttcacgatgccggcgttaacgttaaacaggtcggaacggtccatacccggcttacgcgccacacccgcagaaatcagtactacgtcagcgccttcaagcgccggggttgcgtcttcaccggagaaacctttgatttttacagcggtggggatgtggctcaaatcaacggccacaccgggagtcactggagcgatgtcgtacagggagagttctgaacctgaaggcagttggttttttaaaagtaatgccagcgcctgaccgataccaccagcagcgccgaggactgcgactttcatcctaaactccttattatatgattagctaagtgtctattgctccgcggcggcgaccttaattcacaaattcaatgattacaatcctcactcatcaagaatgcggagtcgcgcaattttggcttttatgcatttaatttgcgtaatccggatcggctgcaaccagagagcaacgttctacaggtggtgacaatataccctactaccctctcaaaacaacatcattttgataacaattaatttacttttaatcttatttgcgaggcgtgacacaggcatgtttcttgataacgaaatttgataaaattccgctctttcataacattatttcagccttaaacaaggcagactgtttgcataaaaattcatctgtatgcacaataatgttgtttctaccgccatattacgggtgacttatgcgaagctcggctaaacaagaagaactagtaagagcgtttaaagcgctcctcaaagaagaaaaattcagctcacagggcgaaatcgtcctcgcgttgcaggatcagggctttgaaaatatcaatcagtccaaggtctcgcgcatgttgactaaattcggcgcagtgcgtacacgtaacgcaaaaatggaaatggtgtactgtcttccggctgaactgggcgtcccaacaacatccagtccgttgaaaaatctggtgctggatatcgactataacgacgctgtcgtggtgattcataccagccccggcgcggcacaactcattgcacgcctgctggattcactggggaaagcagaaggtattctcggcacgattgccggcgacgatactatcttcactacgcctgccagcggcttttccgtaagagatctgtacgaagccattctggaactttttgaacaagagctttagtcccacttcctccgtcgtcgtacggcggaggcacctttttgtcctctcccctcgccgctttcctgtacgcctatcatttggcaaatcatgcccttaaacattcaccacatgaatgataaatcaaaaaaacgcacaaaatgtcaaatttattaagcaattgattttcttttattttttaaacgacagcggcgaaaaacagcaattttaattccataacgttataaaaaataaaatttttaatgtttttaaaaagcagaaacaattagcgtggtattaattaatcgcgtgattagtgtatacttaattttgtgatgagggtcacgaaacaaagtccccagtaaaggaattcgacgaggtaaaaatcatgaaaatcaaaaccactgttgcaacattaagtattctgtccgttctctcttttggcgctttcgccgcagaacctatcagcgcagagcaagcgcaaaaccgtgaagcaatcggatcggtttcagtcagcgctatcggctcatcgcctatggatatgaacgccatgctgagcaaaaaagcggatgaacaaggcgctacggcctaccacattaccgaagcgcgtagcggcagcaactggcacgccactgccgaactgtacaaataaaattcacctgccatcgcatataacgtgtccttgcttcgcggagatatcgcataagaaaagcccattaatccgcgaggttgaccctataaaggaataaaagatcatgaaaacgaaatacattatcgcatcactcggcctggccactctgctctctttcggcgcaaatgccgcagtacatcaggtcaacgcggaacaggcgcagaatctgcaaccgatgggcaccatttccgtctcgcagattggtagtacgccaatggatatgcgccaggagatcgtcgctaaagctgaaaaagcaggcgctaatagctatcgcatcatcgaattaaaagaaggtgataactggcacgccaccgccgagttgtataagtaaaccctcgtcgtctaacccgacgacttgcccccgcctgccgggggcttttttatgctttttcaatgccggacattaaaccgtagccgcccctccagctcttcttccgcttcatcaaagagtaaaatcagcgccccgtagcgcctgcgcagtttatcaggcaggtgaacgaactcaatctctagcggtaggggtaagatatcgctcattaccgcatcccataatgtatcaagatcgcttactttctcactggcaagaccaaacgtctgcgtaaactcgcgataaaaatcgctttggtttttaatatcattaaaatcaaaagtatagacattcatagccagccaccatccccgacagacaattgtctgttttactactaagcatcattatgcagaggtttcacttccagaaacgcttttagccccggagcactcttgcgctgtttttgtatctcaaataagtatagtcataaaaaaaccgacgcttttggcatcggttcttgtgggttagctatcggtaagcgcgttctggtatttatgtaacatacccgtcaggcgtttaaccggttccgtcacctgcggcggcgcctcccagatacgtaatttctcctgatagatatccagctcatccagcaactgaccaaagtagcgtcgccgtttatcatcgcttccggcggaaataacatggtctgcggtacgacgaagctgacggtggaacactgacagatcttcattaaccggtatcggcgcgtcgcgcagacgttgatgagcaatgatcatcgttagcgccaggcggaacttcggcaaatcgccaggaaatttattcatcagcaaaaagagttgctgatataacgcaggcagacggttttctttacggcgtaccacgttggtcgtcattgccgagaccgcagcggaaacaaactgattaagcagcacgcgaccggttcgatctttggatttatcacgcaccagcaggatgacgataaacgccagcatacagccgacaatttgccccaacgcgctgtcgaggaactggctgaaatggaacgtcatcggattatccaacacaataatgttaatcgtactggccagcgcccccatcgaccccagacgccgtttctggacctcaatgccgataaagaaccccaataccgccaggctcaaacataacaacagcatactttgctgcgtattgggaataatcaccaggaaatagagcaatcccagcggcaacgccgccagagtgccataaataaaatcgatgcagaccatgcgcggattgggtaaacgcatcgccagcgaggtcaccacggcaatcatcaccatcgcgccattacccgatgtccagccggtccatagccagaataatgtccccagaatgcaggaaagcgtggtgcgccagaagttcaccatcgcatggtgacgttcagcggattccactttaactacgggctcgccttgcaggatctcttcttccgtcgcgctgattttggtgttactgatcacgccgcgtttaagcaatagatagcgcgtcgcagcgcctacccagctataaagcgtgacgggcgtttcgcgctcgccagtccagacaatgacacgccgcatccgttttaactgtctgtggacgtcctgtaccgtttcaaccggcgtctcgaacagttcccggaatgtatcggtaatcagttccggccgcgtgttttgaataagataagtttcacaggattgcgtaatcagcgtgagcgaaagcgtattcaacgctttcaggcggcggttagcgcgtacccagcgcgaagattccatattcagattacttcgcatcccctccagcgccgccgtgcgtcgcaccagatcgccccaggcgttgtcgacttcttcgctgtcgccatgcttaatacaaagctgcattagctgatattgcgctaccagtaaactgtccagttcgcgatcaacctcctgctttatcgatcgcggcgagaaaagcagatccgctaaaatagcgcagccaatgccgataacgatttcgctacagcgctcaagcgcaaattgcggcgtgagcagcggctccgtctgaatggtaatcacaatgatcagcgcagtataacctgacagtccccacgcataagagttttcgatccgtactaaagaggagatccaggtacaaaaaccggcccagacacagcacaccagaatcatcaataacggcgcgcggatcatagagataataatgataagcgcggcgatacagccaataaacgtcccgataatacgcaacattccgcgataacggatagcgccggaatagggttctccgccggcggcaaatgccgggcctgccgccacgatcgcggcggtcagcaccgcccaacgcggcgtctccagttgaaaatggaagccgataaataatgccagcacaatggcgcacgccagctttaccgcaaaacgaatgtgctggttggcaatggagaaaatgcccatgacgattaaccgaattcgcgcagccggtgcgccagtttacggaagaaggagtcctggcttgcgtcacgatcctgcttaccggtgatcacgacggttgccgtcgtaccggcaggccacaaattcccctgctgctcgtcgagccggatgcgcaccggaacacgctgggccagacgcacccattcgaggttagagtctatcgtcgccatccctttcgcatcgctggtactgctggcattcgttacccctgccgccacgctatcgacggtaccttttaatacccggttgctgccaagcggcgtgatttcggcacgatatcccggacgcacgccttccagcttggtctcttccatataggcctgcacgtaaaaagagttctttttcaccagggcgacggccgtggaaccgcgggtaataaattcaccggcataaacattgaggttagtcacccagccgtcagcaggcgcgcgaataacggtgcgctccagatcgagtttagccaggtcgcgcgtcgcctgggctttagccagttgatgcagtaccgtctgcaagacgttgttcgcctgatcgatctcttcccgggacatcgcctgtacgccgaggcgattacggcgaccggcttcctggcgtttttcctgcgccagtacctgataataggctacatcagcttccgcttccgccagcgctttttgatagcgtggctgatcgatggtaaacaggacctgatcctttttcaccagttggttatcatgcacgtttacatgggtaatcaggcccgcgacatccggggcaatagcgacgacatcggcgctaaaacgcgcgtcgcgcgtccagggagattcggtgtaatacacccaggcgcggaaaatggcgataaaggccagaataaccagtacgagggtaatggccgtacgggagagttttcttgttagtgttttcacttcaacctcaaacgaacaggcgcgatattaaataaaacagacaacaatacagcgcggtattgaacagagccggatgccagacaaaatcatagatgcccgtcggcacaagcatccgacgcaccagccaaaaaatagccagtgacaaaagcaattcgaaaaatatcggtgggaaggaaagaccaaacaccacgataacgggaaacagactcatgttgaccttgatttctgagagagagcaggcgatagattgttaagctacatcgccgcagagaagggcaagagacgccaggcgagagcgacatagctcttattcgaataatagtatattaacgtaattgttatgctgttatctatattatgtgatctaaatcacttttaagccagagtgaataatggaacgattaaaacgaatgtcggtattcgccaaagttgtcgagtttggctcttttaccgccgcagccagacagctgcaaatgagcgtatcgtccatcagccagactgtggcgaaactggaagatgagcttcaggttaaattgctcaaccgcagcacacgcagcattgggctcaccgaagctggaaaaatctattatcagggctgtcgtcgtatgctgcatgaagtgcaggatgttcacgagcagctttacgcttttaataacacgcctatcggtacattgcgtatcggctgttcttcaaccatggcgcaaaatgtgctggccgggcttaccgcaaaattattaaaagagtatcccggtctggcggtcaatctggtgacaggaattccggccccggatttaattgccgacgggctggacgtggtgatccgcgtgggcgcgctgcaagactccagcctgttttcccgtcgactcggcgcgatgccgatggttgtgtgcgccgccaagccgtacctcgctcagtacggcgtcccggaaaaacccgccgatctcagtagccattcctggctggaatatagcgtgcgcccggataatgagtttgaacttatcgcgccggaaggaatttctacccgactgattccacaggggcggttcgtcactaacgatccgatgacgctggtacgctggctgaccgccggaaccggaatcgcttatgtgccgctgatgtgggtgatcgatgagatcaatcgtggcgatctggagatcctgctgcctcgctatcagtccgatccccgtccggtgtacgcgctgtacaccgaaaaagataagctgccgcttaaagtgcaggtagtgattaacgcgttaactgactattttgtcgatgtcgcacacctgtttcagggaatgcacgggcgagggaaagaaaaataaaaacaccgggtaattgctgaagacgattgtaggtcagatgccacccgacgcagacattgcctgatggcgctgcgcttatcaggcctgggcggcacacaccacaggcctgataaggcggacagttatgcggtgccgccaaccgtcaggttatcgactttcagcgtcggctggcctacgcctaccggcagactttgaccctctttaccgcagacccccaccccgttatccagcttaaggtcgttgccgaccatggagatctgttgcatcgtttcaatgcctgatccaatcaacgtcgcgcccttcaccggcgtcgtgactttgccgttttcaatcagatacgcttccgaggtagagaacacaaacttgccggaggtgatatccacctgaccgccgccaaagttaggcgcatagatgccgtattcaacggattcgataatttcctgcggcgttgactgccccgccaacatataggtattcgtcatacgcggcatcggcagatgcgcataagattcgcgacgcccgttaccggtcggcgcagcgcccatcaggcgcgcattcagcttgtcctgcatgtatcctttcagtacgccattttcaatcaatacgttgtactggcctggcgtaccttcatcatcgatagcaacggagccgcgacggttcatcattgtgccgtcatccactacggtgcaaagcgcggaggcaacctgctcgccgatctgaccgctaaatacagacgtcccacgacggttaaaatcaccttccagcccgtgcccgaccgcttcgtgcagcaatacgcccggccacccggcgcccagaaccaccggtaacgtccccgctggcgcagcgaccgcggagagattaaccagcgccatgcgtaccgcttctttcgcccacgcgtcagcgcgaacctcgccgtcgagatcggcaagaaaatactcataaccaaagcgaccgccgccgccgctggcgccgcgctcgcgtttaccgtcttcttccacctgcacgctaacggacaaacgcaccagtggacggacatccgccgccagcgtcccgtcggtcgccgccacgaggattaattcatatacgccggtcaggctggcgttaacttcctgcacgcgtttatcggcttctcgcgccgctttatcaacgcgtctgaggatatccagcttctcttcgcggctcatactttgcagcggatcaagggtggtgtagagcggctgatgcgctacggcggcgagcgtttttaccttgccttcgccgttctcgcgtacaatggttcgcgctgcctgcgcactctgctccagcgccaggaggcttatctgatcagcataagcaaaaccggttttttcgccgctaatggcgcgaacgccaacgccctggtcgatattatatgaaccatctttaatgatgcggtcttctaaaacccaggattcgtgatagctcgactgaaaatagaggtcgccataatcaagacggcgttcggccagttggcccaaaatagcgaacagatcctgatggttcaggccattcgccgctagcaattgttcacttaccaggttcagactcatcgtttttgctactcattgatttctgccggatggcggttcacgccttatccggactacgttgttagattgtgcaaaccggataaacgcagcgccgtccggcatgactatttactgagagtggggcaattcctcgcccccgtcaaatcattgctggctttcttttctcggttggcgcagaacttcgttgatctgcggcgcatcgaccggaccggtaatgcgataacgcagaatggagaccttgctccatagcggccccaacactttactggcggcaaataccgccgcgccgacaatcgggttaacggcaaacgcggcggcgacgcccacggtggcggaaatttccggcgcgacaacggcctccatatcaagacgacgacgcaccagatcaacagaacctttcattgcaatatccgcttccagcccatccaccagcgtatcgtcagtatgtaggacgccatctttaatccacgcggtactatgaatagagtcgaaatagaagccctcgctaaaggtatctctgaagtcaaaccgcagcttacgcagcaacgcatcaaaactgagcagccgcagtagctgtccggcatgaccgctactgagatcagtaaactcgcctttacccagacgcgtgcgtaaaatcccgttgagcgtggcttcatcaggttgccagggcgggtttcgccagtgcagatcgtaatctacgttaaaagacgcgttctggattggcgtcgagataccgaagaacccggcagccgtgtcgaggttactaccatgcagactacctttcagcgaggttcgttcattacccggcgcattcacccactcgccgttcgctttcaaacgggcgaatccggtatcgatcaggccattcgccagagtcagcgtattgcctttgatggcgaaatcgccatcaatacgcccatatttttgcccccatagccagcactcttcgcagcgaagctgtaagtccggccagccacggaagctaatcgtgttcgccgaagccaacggcgatgtcggcgttggtgacgaggcgtgcgtttttgcgacgccagggttgtagtacaggtacttaatgttcgccagccacggcgcatggttgcgcatgagcagcgtggcgttcacctcacggccctgcgcttcaatttttgttccgttcagcgagggggctgaaacgacgctcaaattgttccactgctgaccgcccagcgatagcgcgggagtacgcaacgtgacgcgttgaggaaactcggccgaactgctcacgttatccgccgcgcctttctggaataacgccagccattgcgcgccatccagcgccggcagattgagctcaacgccttgttgagcaggtaatggcggaatcgtccggctgtccgtcgtccagatagcccgatccaacgtcagcttctgatttaataaccagcggctgttaaagtgatttttactccctgcgctccccgttagcgcaaaacttttcaggttgccgtcagcctgaatgttcaccggaatggcttcgcctgcgggtttatttagcggagaaggtaagtgactgctcacatttctcagatcgccattcagctcgatgtgataagtggtgtcagcgtgatacggaagatcgatgccgactttaccattccacgtcacgctgccgctcagggcgtcattcagttgcggcggtaagacgcccatacgcgttggctgccagttaccgttcaggttgacggcgacctgataggcttttgccccttccgtcgtactgaaatccaggttcagcggctgattaaaccagtttgccgtcagcggcccgctttttagcgcgccattcacaaagctgaatttaccgttcagatttttgagcgtgctgtttagcggcttaataaacagactgttattacgcaacgagacatcaccctcagcggtaacctgttcgccatccagcggaatatcaagatgtaagcgagcattcacatcgccatctaactggagctccgccagcgtcgagccaagcgagtcttttagtggcgtctcgtcgaaataaggcccaacggcttttcccggcccgttaatatcggcatcaatgagcagtttctctttggaataatccggaatcgccgccgcgagtttgctggccttcaccccgcccaaatcgacgctatccgaacgcatccacaggccgtcgttcaggaaatccagttcaatgttgagattttttagcgccggccagtcgggttgaaaggcaaacgtcgcattgcgtagcggcaccagcacttcaaactgaccttcgttatgcttatagggaaagaggtgcgggttaccaccgtaaaccaacgtggcgttatccgcctcgccgccctgaattgcgccgctaaggtaatcgaccagcgctttgcccatcaggttttccggaaaatagcgccacgcctgagatccatcgtcggtactgattccggccagaatacccagccacggttcgtcgcccgtcggttgcagatagcggaacccgccgcgcgcgtgtaccgcctttgctttgacgtcaatgtcgcggccatcaagctgaaagccgttctcattcttcaaccaactaagcgtcgcgacgccgttttcaatttccagcggcgcgcgaaaaacggtttcatagggcatcttagcctgctgcatcgcaaccttcatctgcccgtcttctacgcttcccgccagcgtaccggaaaaatgttccgcgccgggcaacagcttccactgtttccaggcaagattttcccacgatgcctgaaaacgcgttttttcggtggcctgtagcggaatatccagcgccagtgtggcgatctttccgctcggctgcgtagcctgccatatttcgcccagcacaggcgacagtttagccgccagcggacgtaatgcttccagccccgccagttcaagattactggcgcgaatgcgtagctcatcgctacgtgtgtgattctcgccgccgacgtcctgctgcgggagccaggccacggttaaggctccgctcggccagggtttaccatcaagcgtaatccgtgtgtccggaatataaaactgccagcccggctgctcacggctaatctgcgccgtcaggttatcgacagacaacgtgtgcgtcgtgttatcgcccaaccagcttgcgccgccctgtttcagccagacgtctcctccggcgatttcacctttactgagcgtcatccagccttccagactgaaacgcgccgtctggagcgccacattatcctgcatccatttgcccagccacggcttgacgtcaatatcgtcggcctgtaaccagactctgccgttatttagcaaaccgtcgtcatcgcgtaaatccatccgcacctgcatcacgccgtgctgcccggtcaggctggagagactgacctcgccttcggcgcggtgccgctctttgccgtttagccaggtaagctgtgggatcgccagctccgcgcgttgtccggaaagcgtcagaaaactgatttggctatcgcgcagatcgaaatgatcgaactgccgcaggaaaagatcgcttaaacggctggtttcgatgccttcgccgtcgctgctttgaagaggcgtgttggtgcggaaattgagttgccagaaggtcaggtcgcgaaactgccagcgcatatgcaacaggctttgccagacgtccagcgccagcgtaacgcgttttatcgacagttcgccgccatctttcagggcggcatgaatattatgcgcttccagcgtagggccaaaattttgccagcttgcggagagttggctggcggccaccggcacgccggtcacagactcaattttattcaggatagccggacgccaggcgtcaagatgaggcaacgccaggcgcagcccgctaaccagcagcgctgcaatgacgatgagcgcggctccagtgagcaataaaatccccggcaatcgcctcacgcgtctctccttgtctgccaaaaaatacgactcacaaccttgctttgccggacggcggcgtgaacgccttatccggcctgcaaatactcgtacgggtcgcggtcttttacatcattacgacgtcaaactgctcctggttataaagcggttcgacctgaactttaacctgtttgccgacaaagatttcgacttccgccagcgcgtgtgattcttcgcctttcagcgcttccgccaccgcaggagaagcataaaccaggaagcgatcggagtcataagcgtgatgaacacgtacaatttcacgcatgatctcatagcagacggtttccaccgtttttaccgtcccgcggccatgacaggttggacattcgttacaaagcacatgttccacgctttcacgagtccgtttacgggtcatttccaccagccccagcggcgaaaaaccgttaatactggttttcacgcgatccttacttaacgcctgttccagcgaatgcagcacccggcggcgatgatcttcattattcatgtcgataaaatcgataatgataatgccgcccagattacgcaggcgtagctggcgggcaatggcctgagtcgcttcaatattggtattaaaaatggtgtcgtcgagattacggtgtccgacaaacgcgccggtattgatatctaccgtcgtcatcgcttcggtttggtcgataatcagataaccgccagacttgagttcaaccttacgctccagcgcgcgctggatctcattttccacgtcataaagatcgaagatcggctgatggccactgtaatgctccagcttactggtcatttccgggatgtattctgcggtaaactccagcagcgactcataggtcagacgtgagtcgacgcgaattcggtccaactgcgcatcggcgaaatcgcgcagcacgcgctgcgccagcgccagttcgccatacatctggtagcgcgtttgcggacgctttttgcgctccattactttcgtccagacgcgcttgagataggcggcgtcagacgcgagatcctcttcacacacgccttccgctgcggtacgaataataaacccgccctgttcgtcgcagtattccgccaccacctttttcaggcgctcgcgttcactttcgctttcgatgcgctgggaaacgccaacgtgtgacgcgccgggcataaaaacaaggtaacgggagggcaacgtgatgtccgtggtcaaacgcgcgcctttcgtgccgagcggatctttcactacctgcaccatcagatcctgtccctgacgcaccagttcggagatatcgcgcacggtaaactgtttttgctcgtcgcccgccacgcattcggtatgcggcataatgtcggaagcgtgaagaaatgcggctttatccagcccaatatctacaaaagccgcctgcatacctggaagtacacgacttacacgacctttgtagatattgcctacgattccgcgtcgcgcttcgcgctcaatatggatttcctgaagaataccgccatcaatgtacgccacgcgcgtttccgatggcgttacgtttaccaacaattcagccgtcatgtttatcccttttatcacgcagtgcgttaaaatgactcaacaactcatacgtttcaaccagcggtaagccgaccacggcgtgatagctgccatttatcttcctgacaaaacagccaccccgcccctgaataccgtatgcacctgctttatctaaaggctcgccgctggcgacatagccagtaatatcctgcgcagaaagcgtgcggaaagtcacctccgttaccaccagacaatccagcgtctgctgcgagtccgcaagcgcaacagcagtcatcacctgatgcgtatttccggaaagcaaacgcagcatttctgcggcatgagcggcgtcgcgcggcttttccagcacctcgccgtttaacacgactatcgtatccgcgcccaacaccggcagatcacggggaaccagcgccacgccagcctgcgccttttcgcgcgccagccgaacaacatactgctgcgcgctttcctgagcacgccgttgctcttcaataccaggcacgacctgctcgaatgaaaatccaagttgagtcaataattcctggcgacgcggggaaccggaagcaagatacagagttgtcatatcgacctttattgcacagcaaactgctggcgtactttacgcatcagcaaaaagagccagggccacagcacgccattgactacactactccagaacacttccggtctgaaagagacgttgatcactaaaaactcggcccagaaaacaataatgtccacggccagtgaaagcaacattaccaccagcgcctgctgccagagcgccaggttacggaagagctggaatttcagagcgaccagataggcgacaatactcatcgacagagcgcgcacgccaagtgtggaaccgctgatgagatcaagtatggcacccatcacaaatcccgtccccacatttacgcggtgcggcagggccagaatccagtacagtaagatgagcaaaacccagtttggccggaaaacaatgatgtcgtccggccagggcatgatttgcagcaacagcgcaataagaaacgagagccagataacccagcgcccctggctacgatagctcgccaccattaccctcccggcgcacgcgcaggcggcgtggtcgcgcccgaaggcgatggttgcgttgataccggcgccgtctggcccgcagatggctgagtaatccccgtcgccgggtccggcactggcgccggcggccccatcgcatccggagaaggcaacacctgcggcatcatctgcatcaggcgctcattggcgacgcggtgaacctcttccggcgtcatcggattggcgccgttacgatcggctccccacaacagcagcagatagcgtaaacgctgcaaacccgcggttggacgtgcctgaatgacggtataggcgcgctgagtgtccagcttgacggaggagaccaccgccaccggatacccttccgggaaacgcccaccaagtccggacgttaccagcacatcgccaacgcgaatatcggtattggcgggcagatgttcaagctgaagatcgtcagtgcagccgttaccggcggcaatcacgcggatgtcattgcgcagtacctgaatcggcagcgcatgagtcgcatcgcaaatcagcagtacgcgactggtcagtttcgccacggcgacaacctgccctacgacgcctttgtcgctaatgaccggttgaccttcatatacgccattaacgctgcctttatcgataacgacctgatcgctgtaaggatcgttaaccgttgaaataacctgagtcaccattttctgctcgtcctgacgcagcggcgaccccagcagctcgcgcaaccgcgcgttctcctgtttgtactgccccagcatcagcaggtcgctgttttttagcagtaattcctggcgcagcgcccgattttccagctcaagctggtcgcgagaagccagcgtttgcgacacgctgtcgagcagttcacgagggccgtttgaaataaaatagaaaggactgacggcagtgtccatgtacgttcggatttgactgaacgtccccaggcggctgtcggcaatgataacgccgagcgccaccagcaccgccagaataaggcgaatctgtagcgacgggccacggctaaaaattggcttcataggctatgcgtattctcgcgtcggagaggcaggacaatccagggataatcctgcccgtatccaactactcttcgctgaacaggtcgccgccgtgcatatcgatcatttccagcgccttgccgccgccgcgcgccacacaggtcagcggatcttcagcaaccacgacaggaatgcccgtctcttccattaacagacggtcaaggttacgcagcagcgcgccgccgccggtgagcaccataccgcgctcggagatgtctgacgccagctccggcggacactgttccagcgccaccattaccgcgctgacgataccggtcaacggttcctgcaacgcttccagaatctcgtttgagttcagggtaaagccgcgtggaacgccttccgccaggttacggccacgcacttcgatctcgcggacttcgtcgcccggataagcggaaccgatttcgtgtttaatacgttctgcggtggcttcaccaatcagagaaccgtagttacgacgaacgtaattaatgatggcttcgtcgaaacggtcaccaccaatacggacagaagaagagtaaaccacgccgttcagggagatcacggcaacttcagtggtaccaccaccgatatccacaaccattgaaccggttgcttcagaaactggcagacctgcgccgatcgcggccgccatcggctcttcgatcaaaaagacttcacgggcgcctgcgccctgagcggattcacgaattgcgcggcgttctacctgcgtcgcgccgaccggcacgcataccagtacgcgcgggcttgggcgcataaagctgttgctgtgcacttgtttaataaagtgctggagcattttttcggtcacaaagaagtcagcgataacgccgtctttcatcggacggatcgcagcgatattgcccggcgtacggcccagcatctgcttcgcatcatgaccgactgcagccacgcttttcggcgaaccggcacgatcctgacgaatggccacaacggaaggctcattcaatacgatgccttgtccttttacataaatgagggtattcgcggtacccaggtcaatggacaggtcattggaaaacatgccacgaaattttttcaacatactaagggataatcctgaaagctggggcggaaaacaaaatccgcttactttaccaaccacacgcagcagcgacaaggcgcaaaaatcatctgctacggtgaaaattagtgcagttcgtttcctttgttacaaatctcggcctgagtccctcagggctgaaaaaatcagcagcaatcctcgccttcgtttgcaacctgtcaaaggtcattcacctgcatatttgctgcaacaatctggcgagcagacaagcacacccccatgaggcgcagcgcgcgttattctacgtgaaaacaaattaaacggcaggttaaaccgagtatctttgcgaatattttttcacgtttgtgtcaagtagttgggaggaggcaaaaaaatcaccctgcccgccagccacgccgcgttttgtcagcgtctgccactcgccgcgcgaacggacgcctgtcgcgtaaacctgcgtaggcgtgcccgcgcaggcctctaccagactttgaaccagaagctggttttccgttcgcttctcaatgtttctgaccagactcggatgcagcttgagtaattccacattgagcgctttaatccagctcgtgctaaccagcgtcaaacccgcctgtgtcaccgccacccgaacgccaagcgcattgactaagcgaaggatgggttgtaaccgactgatgtgttgacaaacatctgcctccgcaagttcaataattatgcgatttcgctgtgatttttcacactgcattaacgtatcgcgcaaccagcgctgaaaacgcggacgaatcagcgactcaaccgtcaactgcattgccagattttcatccggccagtagcccagcaacgtaatcaggcggctaatttgtaatctgtcatactcttccgataaaccaaattgcagcaccatcggcatatactccgccgagctcacctcttctttaccgtcatagatgcgacacatcaattcccgatgatgtacgcgaccttctcgcgtgaccgctggtttttgataaagtcgcggtccaccccggttcagcatctgctcaatcaatgtgcgccagcgcacattgccgcgccctttttccggcagagtgtcgtcgtagatagcccagctatttcccccctgcagggcggcattccgcgccgcggcttcagcatgttccatcacctgctcggtggactgtccgctgcgccaggcgcaaatgccgatatgtaccatatcgtcacgatcgagcattttgttagccggtagcgcatcgacagcttttaaaagttgtccggcaatactttccgcttctttcagcgttcgatgcggtagcagcacggcaaagtcgctgcggtgataacgcgccagcagcgagccagggtaacgcataataaatgtcgatagcagattgataagcataaacatctgctcttccgcctgattgcctcccaggctgtcgcgcagaagattgaagtctggcaagcggatcatcatcaccacgccatgcactcccactttttcctgatcttccagcagcgtcgccagttggttatcaaagaacagacggttaccgagtccggttttggtgtcctgcgcggcgtaggagcgaatgagggtgtccaggcggctacgctgttcgtgagcaaactgaatttcggaaagcaatacatcaagcgcgctactggtgcgcgctggccattcgtaaacagaaccgcggacattcgccccgcgttcgccgttcagaatacgcgttgagcgaatttccagaagctcttgcccggaaagctgccgctgcagccagcgcaccgataaaaacaaaatcagaacgataaaaccgatcgccagcgttagcggcgccgtggtgatcagtgagtgaaaatagttacccatcgggtcctgataagccagacgtagcgacattcctggatgttttatcagcggtacgaccagctcgcgatacatgtcgctggtgccggctggccgataacctctggcacgagaatggctgtagacgctgcgctccccctgcaacagatcgacacgcacaatatcggaagcgatcatgagttcgtcgatttgcggcgtcagcgagacaatatcatgggtcaccaggtgcgtatcaatggctgtcgccgtcgcctgcacacggctgacatacttatactgtacggcgttataaaagcttagcgagcaacctatcagagtcacgaagatcgttaaccccgtgagcagcgtgataaaagctgagaatttcgtcgttaatcgcatccttgagttaactccgacggttataaacagtatgaaaaagcgaatctgaaggcggaattcgccacggcgcgcaatgaagcaggcatactaccaaaatggatctatctggcaatttattgcgttgcatcggcatcacgttttaattagcgagtatagtcttcgtagctatttttccaatctaccatgtaaagtgaggacaggttatgcaggcgttgatcttagaacagcaggacggtaaaaccctcgcatccgtgcaacatctcgaagagagtcaactgccggcaggtgatgtgacggtggatgtccactggtccagcctgaattataaagatgctctggctatcaccggaaaagggaaaattatccgtcattttccgatgattcctggtattgatttcgccggcaccgttcacgcaagcgaagatcctcgctttcatgcaggccaggaagtactactgactggctggggcgtgggcgaaaaccactggggcggcctggccgaacgcgcacgcgttaaaggcgactggctggtcgcgctgcctgcgggactgagcagccgtaacgccatgatcatcggcaccgccggttttaccgccatgctgtgcgtcatggcgcttgaagatgcaggtattcgcccgcaagacggtgaggttgtcgtcaccggtgccagcggcggcgtgggcagcactgccgttgcattactgcataagctgggctatcaggttgcagcagtatcaggacgtgaaagcacccacggctatcttaagagcctgggagctaaccgtattctcagccgcgatgagtttgctgaatctcgcccgttggaaaaacagctatgggccggtgcaattgataccgttggcgataaagtgctggcgaaagtgctggcacagatgaactatggcggttgcgtggccgcctgcggcctggcgggcggcttcgcgctgccgaccaccgttatgccattcattctgcgtaatgtgcgtttgcaaggggtagactcggtgatgaccccaccggcacgtcgcgcagaagcctgggcgcgtttggttaaggatctgccggaatcgttctatgctcaggccgccacagagattacgctggcggatgcgccgaagttcgccgatgccatcatcaataatcaggttcagggccgtacgctggtgaagataaaataacgtcacgtataaaaaaatttacacttaattaactatttatttttacacattgacacactccctgtcatattcactacacgccatgttgtggtgggtagaccgggagtctgtgatgaaaaagatacgtccattaacagaagccgatgtgactgcggaatcggctttttttatgcagcgccgacaggtgctaaaagcattaggcatcagcgcggccgccttatccttaccctcaacggcgcaggccgatctcttcagttggtttaaaggcaacgatcgtccgaaagcgcctgccggtaaaccgcttgagtttagtcagcctgccgcctggcgaagcgatttagcgttaacgccggaagataaggtgacgggctacaacaatttctatgagtttggccttgataaagccgacccggcggccaatgccggaagtctgaaaaccgaaccgtggacgttgaaaatcagcggggaagtcgcgaagccatttacgctggattacgacgatttaacacatcgtttcccattagaagagcgtatctatcgaatgcgctgcgtcgaagcgtggtccatggtcgtgccgtggattggtttccctttatataagctactcgcgcaggcacagcccaccagccacgctaaatatgtggcattcgaaacgctatacgcgccggatgatatgccaggacagaaagatcgctttattggcggcggactgaaatacccttatgtcgaagggctacgtctggacgaagccatgcatccgctgactctgatgaccgttggcgtctatggtaaggcgttacccccgcaaaacggcgcgcctattcgactcatcgttccatggaagtatggttttaaaggtattaaatctattgtcagcattaaactcacccgcgaacgtccgccaaccacctggaatttgtcggctcccaacgaatatggtttttatgccaatgtgaacccgcatgtggatcatccacgctggtctcaggctaccgaacgctttattggttcaggcggtatccttgatgtgcaaaggcagccgacgctgctgtttaacggctacgccaatgaagtcgcttcgctgtatcgcggtctcaatttgcgggagaatttttaagtgcgtctgacagcaaaacagataacctggctaaaagtttgtctgcatcttgccggttttttgccgcttctgtggctcttttgggcgataaatcacggtggactcagcgcagacccggtaaaggatatccaacactttaccggcagaaccgcgctcaaatttttgctcgccaccttgctggtttcaccgctggcgcgctacgctaaacagccattattgatacgcacacgccgcctgttaggattatggtgtttcgtttgggctacgctgcatttaaccagctatgccttactggaactggggatacataacctggcgctgttaggaagcgagttgatttcacgcccttatttgacgcttgggatcattagctggctggtgttattggcgctgacgttgacctcaacgcaatttgcgcagcgtaaattgggcaaacgctggcaaacactgcataacgtcgtctatcttgtcgcgatcctggctcccatacattacctgtggtcggtaaagattttatcaccgcaaccggtcatctacgcggcattagcgttagcccttttagcgttgcgttaccggaagtttcgccagtggtggcgctagtttggtgaactgtgcggtcgattgcaaaacgcaaaacaggtaatgtcctttttatgtttcgggttgattatcttccctgataagaccagtatttagctgccaattgcgacgaaatagttataatgtgcgactttacattgcccaacggcgattttcgttcgcagaaagggtgacaatcgagcaatgaaggtatattttgttttttgcccgaaaatggcagaagatagccacacaatgactggcaaatcatgaatttcaccttcgggtgctacggcataacaggcaaatcaaagatgcgcggtattttacccgcggcagtcattcacatgctttacagacggcgctaaaacgcctgtcacaatcacactaaacaaagagtacggaacccactcatggatattcgtaagattaaaaaactgatcgagctggttgaagaatcaggtatctccgaactggaaatttctgaaggcgaagaatctgttcgcatcagccgcacaacggcaaacgccggttttccggtgatgcagcaggcttatgcggcgccgatgatgcagcaacccgctctgtctaacgctgtcgcgccagcggctactccagcaatggaagcgcctgccgcagcggaaatcagtggtcacatcgtacgctccccaatggttggtactttctaccgcaccccaagcccggacgcgaaagcgttcatcgaagtgggccagaaagtgaacgtgggcgataccctgtgcatcgttgaagccatgaaaatgatgaaccagatcgaagctgacaaagcaggtactgtgaaagcgattctggtcgaaagtggtcaaccggtagaatttgacgagccactggtcgtcatcgagtaacgaggcgaacatgttggataaaattgtcatcgccaaccgcggcgagatcgcactacgtattcttcgagcctgtaaagaactcggcatcaagaccgtcgctgtgcactcaagcgcggatcgcgatttaaaacacgtattgctggcggatgagacggtctgtattggtccggcaccgtccgtaaaaagttatctgaacatcccggctatcattagcgccgctgaaatcaccggcgcggtggcaatccacccgggttacggcttcctttctgagaacgccaattttgccgagcaggttgaacgctccggctttatctttatcggcccgaaagcggacaccatccgcctgatgggcgataaagtgtccgcgattaccgcgatgaaaaaagcgggcgtgccgaccgtaccaggatctgacggcccgctgggcgacgatatgaatgcgaaccgcgctcatgccaaacgtattggctatccggtgatcatcaaagcgtccggcggcggcggcggccgcggtatgcgcgtagttcgtagcgatgctgaactggcgcagtccatctccatgaccaaagcggaagcgaaagcagctttcagcaacgacatggtatacatggaaaaatacctggaaaatccacgccacatcgaaattcaggtgctggcggacggccagggcaacgctatctatctggcggaacgcgactgttccatgcagcgtcgccaccagaaagtggttgaagaagccccggcgccaggcattacgccggaactgcgtcgctatatcggcgaacgctgcgcgaaagcgtgcgtagacatcggctatcgcggcgcagggacgttcgaattcctgttcgaaaacggcgagttctatttcatcgaaatgaacacccgtattcaggttgaacacccggtgactgaaatgattaccggcgtcgatttgatcaaagagcagttgcgcatcgcggcgggtcagccgctgtcgatcacacaggacgaagttgtcgttcgaggccatgcggtagaatgccgtatcaatgccgaagatccgaacaccttcctgccaagcccaggcaaaatcacgcgcttccatgcgcctggcggctttggcgttcgttgggaatcccatatctacgcgggctacacggtgccgccgtactatgattccatgatcggcaaactcatctgctacggtgaaaaccgcgacgtggcgattgcccgtatgaaaaatgccctgcaggaactgattatcgatggtatcaaaaccaatatcgatctgcagacccgcatcatgaatgacgagcacttccagcacggtggaaccaacatccactatctggagaaaaaactcggtcttcaggaaaagtaatcgcacgttaatctcaaaaggccggtgaatccggccttttttatttctggggatagcgatgccccatcatgtacaattcccgctttcttcacccataagggacaaaaaatggacgctcgttttgttcaggcccataaagaggcgcgctgggcgctgtggctgaccctttgctatctggcggcatggttagtggctgcttacttacctggagactcgccgggaatcaccggtctgccgcactggttcgagatggcctgcttattgacgccgctggtctttattttgctgtgctgggcgatggtgaaattcatttatcgcgatatttcgctggaggatgacgatgcagcttgaggtcattctaccgctggtagcctatctggtcgtggtcttcggggtctcgatttacgctatgcgcaagcgtaccgccggcacctttttaaacgaatattttcttggcagccgttcgatgggcgggatcgtgctcgcgatgacgcttaccgccacctatattagcgccagttcatttatcggcggtcccggcgcggcttataaatacggtctgggctgggtcttgctggcgatgatccagcttcccgccgtctggctttcactgggtattctgggtaaaaaattcgctatcctggcgcgtcgctataatgccgtcacgcttaacgatatgctattcgctcgttaccaaagccgcctgctggtgtggttggcaagcctgagtttattggtcgcgtttattggcgcaatgaccgtacaatttatcggcggcgcgcgactgctggaaaccgcggcgggaattccctacgaaaccggcctgctaatatttggcgtcagtatcgcactctatacggcgtttggcggctttcgcgccagcgtacttaacgatacgctacagggcctggtgatgctggtcggcacgatagtgctgctggtgggcgtgatccatgcggcgggcggtctaagtcaggccgttgacacgctgcacgctctcgaccccaaactggtaacgccgcagggcgccgatgacatactttctcccgcctttatgacctctttttgggtactggtctgttttggtgtgattggcctgccgcatacggcggtgcgctgcatctcctataaagacagtaaagcggtacaccggggcattattatcggtacgattgtcgtggcgattttaatgttcgggatgcaccttgccggcgcgctgggtcgcgcggtgcttccggatctgacggtgccggatctggtgatcccaacgctaatggtgaaagttttgccgccgtttgccgccgggatcttcctcgctgcgccaatggcggcgatcatgtcaacaattaacgcccaactgctgcaaagttccgcgacgatcattaaagatctctatctcaacctgcgccccgatcagatgcaaaatgagatccggctgaagcgtatgtcggcagcgattacattactgctaggcgcgctgttgctgctggccgcatggaaaccgccagagatgatcatttggctcaacctgctggcgtttggcggcctggaagcggtgttcttatggccgctggtattgggcctttactgggagcgggcaaacgcggcaggcgcattaagcgccatgatcgtgggcggcgtgctatatgccctgcttgccacatttaatattcagtacctgggctttcatccgattgtgcccgcgttactgttaagtttattggcttttctgatcggaaaccgattcggctcttccgcttcgcaagccaccgtattgtctactgataaataaagagttttgccatgccatggatccaattgaaactgaataccaccggcgcgaatgctgaagagctgagtgatgcgctgatggaagcgggcgccgtttccattacctttcaggatacgcacgatacgccggtttttgagccgttgccgggcgaaacccgtctgtggggcgataccgatgtgatcggtctgttcgacgccgaaaccgacatgaaagacgttgtcgcgattctggagcaacatccgctgctgggtgccggatttgcccataaaatcgaacaactggaagataaagactgggaacgcgaatggatggataatttccatccgatgcgttttggcgagcgtctgtggatttgtcccagctggcgtgacattccggacgagaatgccgtcaacgtgatgctcgacccgggactggcgttcggtacgggtacgcaccccaccacctctttatgtctgcaatggctggacgggctcgatctcaacggcaaaaccgtgatcgactttggctgcggttcaggcattctagcgattgccgcgctgaaactgggagcggcaaaggcgattggtattgatatcgatccgcaagctattcaggccagtcgcgataatgctgaacgcaacggcgtgtctgaccggctggagctgtacctgccgaaagaccagccagaagccatgaaagccgacgtggtcgtcgctaacatcctggcaggcccattacgcgaactggccccgttaatcagcgtactgcccgttgagggcggtctgctggggctttcaggtattctcgccagccaggcggaaagcgtctgcgatgcttacgccgagcttttcactctcgacccggtcgtcgaaaaagaagaatggtgccgcattactggccgtaagaaataattcttgtcagcgtggtcgcccggccacgcttttctccacacaactgccttaacgcctttcaggcaccgagacatcattaaattcatcaaatgaatgcctgaaataacttctttgtcactatccgtctggataaacagctgctaccagcggacaaaagatactggcgttttaacgggtcgcagccatcgccctcgtacttagtaatgctgtccgggttgttctgcagcatccgctaaccctctcttcagcgcagctggaaaaatttatccgtgccattcatgaacacaaaagcgcatctgtgcgcccccttccgactggcaatggagaaaaatcacgcgcagcgggaagtgatcttgtcctgaaacgagacggcgatcccattcatttggggtaattagcttataaaaaaagcagattattccgcttatcttgtttctggacgaagaaatagagagaagttacgggaatttgtaagcgcgtacaaaaccgccgacaataaataaccctatgattttaatgaattataaatttattttgctgtttttaagcacgattcattgatctacaacagtggattgttcaaagtttggcctttcatctcgtgcaaaaaatgcgtaatatacgccgccttgcagtcacagtatggtcatttcttaactcatgcgcatcggacaatatcagctcagaaatcgcctgatcgcagcgcccatggctggcattactgacagacctttccggacgctgtgctatgagatgggagcaggattgacagtatccgagatgatgtcttctaacccgcaagtgtgggaaagcgataaatctcgtttacggatggtgcacgttgatgagccaggaattcgcacggtgcaaattgccggtagcgaccctgttgagatggccgatgccgcacgtattaacgtggaaagcggcgcccagattattgatatcaatatggggtgcccggcgaagaaagtgaatcgtaagctggcaggttcagccctcttgcagtacccggatttagtgaagtctatactcatcggggtcgtaaacgcagtggacgttcctgtgactctcaagattcgcaccggctgggcgccggaacaccgtaactgcgtagagattgcccaactggctgaagattgtggtattcaggctctgaccatccatggccgcacccgcgcctgtttgttcaacggagaagctgaatacgacagtattcgggcagttaagcagaaagtttccattccgattatcgcgaatggcgacattactaacccgcataaagccagagctgttctcgactatacaggggcggatgccctgatgataggccgcgcagctcagggaagaccctggatctttcgggaaatccagcattatctggacactggggagctgcttccgccgctgccgctggcagaggtaaagcgcttgctttgcacgcatgttcgggaactgcatgacttttacggtcaggcaaaagggtaccgaatcgcgcgtaaacacgtctcctggtatctccaggagcacgctccagacgaccagtttcggcgcacattcaacgctattgaggacgccagcgaacagctggaggcgttggaggcatacttcgaaaattttgcgtaaacagaaataaagagctgacagaactatgttcgaacaacgcgtaaattctgacgtactgaccgtttctaccgttaactctcaggatcaggtaacccaaaaacccctgcgtgactcggttaaacaggcactgaagaactattttgctcaactgaatggtcaggacgttaatgacctgtatgagctggtactggctgaagtagaacagcccctgttggacatggtgatgcaatacacccgtggtaaccagacccgtgctgctctgatgatgggcatcaaccgtggtacgctgcgtaaaaaattaaaaaaatacggcatgaactaatttcgattagctaactgcttgtttaaaaaggcgctactcggcatggggaagcgccttttttatacgcatcacatggaatttggtcatgaaagcggaatgtgaacctcagtactttggcgatgaatcgaagaagattattcacggtgacgcgctaacagaacttaaaaaactgccttctgaaagcattgacttaatttttgccgatccgccttacaatatcggaaaagatttcgacggtatggtggagtcctgggacgaagcgtcttttctggcctggctgtatgaatgcattgatgagtgccaccgcgtactgaagaaacacggcaccatgtacatcatgaatagcacagaaaatatgccgtatatcgatctcaaatgccgaacgctttttaccatcaaaagccgtatcgtctggtcctatgatagttccggggtgcaggcgaaaaaatactttggttctatgtatgaaccgatcctgatgatggtaaaaaacccgaaaagctatacctttaaccgtgatgcgattctggtcgaaaccactacgggcgctaagcgcgcgctaatcgattatcgaaaaaacccgccccaaccatacaatcagaaaaaagtgccgggcaacgtctggtcatttcctcgcgtacgttatctgatggatgaatatgaaaaccatcctacgcaaaagcccagcgcgctgttaaaacggatcatactggcctcttctaacccgagcgataccgtattggaccctttcgcgggcagtttcaccacaggcgctgtcgcagcggcgtcaggtcgtaagtttatcggtattgaactcaataatgagtacgtaaaaatggggctcagaagattgagcgtcacttcgcattattcagaaaatgaacttgcaaaagtcaaaaagagaaaaacacaaaacctgtccaaaaagcagcgaaatgtcgggataaacgcgctatcttcagagaagtaaaagcattgtaagtccgcttttcagcgtcaaaatttcatgtatattcccagcacgcatgggcatgaatacacaggatttgacgatgatacgtaagtattggtggctggttgtttttgccgtctccgtttttctttttgatgcgcttttgatgcaatggatcgaattgatggcaactgaacaggataagtgccgaaacatggattcggttaaccctctcaaattgatcaattgtaccgatctggagtagcgaaccgggcgatttaacctatgattatttatcacccggatttcttttatcccttataaaaacagggaattaaaacacgttgaggataaaagaaggggtgatactgtctcgtcctgttcttttcctgcataaccaatgagctaatgatacatgccggttagtgagtacaaccacatccttgtggcggtttcatttgctgtcgctatttttgcgtcctataccgcattaaatatggccggacgcgtagccggaagcgcccgatcaaacgccagaatatggctaatgggcggcggcttcgcgctgggcgtcggtatttgggcgatgcattttgtcgggatgctggcgatggatcacgcgatgaacatgcgcttcgatccgttcctcaccggcctctccatgctgatcgcgatcggctcctccctgtttgcgctatggctggtcagcgctgaaaaactgcgcctgcgccgtttactgccgggcgcgctggtgatgggactgggcatcagcgcaatgcattataccgggatggcggcgctgcaatttgcttccattatcgtctggaatagcgcgtgggttgccctctctatcattatcgcgctactggcgtcctgcggcgcgctgtggctcacgttccgcctgcgtcatgagggaacagatgtcgccctgaggcgagcaggcgccgcggtattaatggggatagctatcgccggcatgcattacgccggcatgaaggccgcacactttccccaaaactggccgatggagcatcgtggcgtcgatagcaactggctggctgttcttgtcagcgtggtcgcgctgactatcctgggtattactctgctggtttctttatttgacgcccggcttcaggcccgtaccgcactacttgcctcttcgctggcgcaggcgaaccaggaactggcgcagttggcgctgcatgatacgctcacccgtttaccaaaccgggtgcttcttgaggatcgtctggaacaggccatcagcaaagcgaatcgggaaaacacgtctttcgcgctactgtttatggatctggatggctttaaaaccgttaatgacgcttatggtcatgatatcggcgataagctactggtagcggtcacgcatcgtctgaaccaaccgctgagcgggcagtttaccctggcgcggattggcggcgacgaatttgtgctgcttgcagaagtcagcgcgcctgacgaagcggcttcccttgccagcgcgctggtacattcgatagatgcgccctttacaatagatccgtacgaactggtcgtcacccttagcgtgggaatagcgctctatccgctggacggaaaaaacgaacgggaactgatgttcaacgccgatgccgcaatgtaccacacgaaacatacggggcgtaacggataccatttctttcagccatcaatgaatatgctggcgcaaacccaacttcagctaatgaatgacctgtggctggcgctggaaagacaagagctcaggctagtgtatcagcctaaatttcaggctcctgccggccctattgtaggatttgaggccctgttgcgctggtatcatccaaaacaaggcgtactgaatcctgaccagtttttaccgctggcggaaaaaacgggtcttatcgtcactatcggtagctgggtgatagacgaggcgtgtcgacagctccgcgagtggcacttacagggatacgacttatggtcagtggcggtaaatctgtccgccttacaatttgagcagcccgggcttgtggacaccattacgcggagcctggcccgacacagtatccgtcccgatttattgattctggaaatcaccgaaaccacggcgatgaacaagccagagcaaagcgtcgctatactcaccagattaacggaaatgggggttaaggcctctattgacgactttggcaccggttattccagccttctctatctgaaacgtcttccggcgtgcgaactaaaaattgatcgcgctttcgtacatgaactcagcgaggcaggcgacggcgcgaccattgttgcggctattgtcgcgctggcgaaagcgttaaatctgcaaattgtggcagaaggggtagagaatgaaacgcagcaacaatttttgacccagttaggatgccatacgcttcaggggttcctgcttggcaagccgcgtacggcagaggaaattgctcgcgatattcgggatcctgccaatatattcacaaggtcaatatataatatcaactcaaaataatctcaggcttcttccgcctgttgttcatttggcattaattgcctcacactgccatccgggcttagcatttttaatacattatcgactaatgcaggcgcctgcttataaagatcataacttgtgggattcattaaccagttttttactattccgctaaaactaccatgcagaataattaatatgacatccagatcaagactgcctgagatcagttttttatccatacatcgctgtaatacttcaagcagcgactgatgatggaaacccatcttctcccgaatggcctgttccgatatcataccattatggaattcacatttatgatataaaatctgcattaatgcctgctgacgaggcactgccgcaatatattgtaaggctgcaataaatttctctcgtagatcctgtaaaggattatcattccagcatcccgtaagcctatcctgaataagttcgcgtaaaggtggttgctgtaaccaaacctcattaaacaactgcgttttattctcaaagtgccagtagatggcgccccgcgtgacatcagcggcatcagcgatatcattcaacgtcgtgttggcaacgccgcgcaaagcgaactgcgcaatagcggtttcaatcaaatgttgccgcgttttaagcgcatccgccttcgttttcttcgccataattaagatatcctggaccataaaaacgataaatacgctgataaaatactcagcacaaaaaacaactttatcatgtcctttttagtcagacgagagacagctatttttatttcgcacaatatcgccaaatcaataataaaaacaaataaattaataaaacacattcatataaaatatatatttctatttatgttattcaacatcatgattttactaatcgggacattatgaaacgacagggaatagttctttttttttgcttttatgtgccgtgaaccccatcccaaaataagtattgcttacatcacaagctaataatttgtaggataccccactgctattctatttttcgcgcgttaacgccttaccgttatccggtgaataacgagctttcggttttttaaggaacagtaatgacgaaacatgccaggttttcactcctgccctcattcatcatattctctgctgcgctgctggccggttgtaatgaccagggagatacccaggctcatgccggcgagccgcaagtcaccgtccatgtggtcgaaacagcgccgctagccgtaacgaccgaacttcccggacgtacgtccgcatttcgcattgcggaggttcgcccccaggtgagcgggatcgtgcttaaaagaaacttcaccgaaggtagcgatgtagaggccgggcagtcgctctatcagatcgatcctgccacttatcaggctgattatgacagcgctaaaggcgaacttgctaaaagcgaagcggctgcggctatcgcgcacctgacggtcaaacgctatgttccactggtcggcacaaaatatatcagccaacaggaatatgatcaggcgattgccgacgcccgccaggccgatgccgccgttgtggcggcaaaagccgctgttgaaagcgcgcgtattaaccttgcgtataccaaagtcacctcacccatcagcgggcgtataggaaaatctaatgtgactgaaggcgcgctggtgactaatggtcagtcaactgaactggctaccgtgcaacaactcgatccgatttatgtcgacgtgacgcaatcaagcaacgactttatgcgactcaagcaatccgtcgaacaaggtaacctgcataaagacagcgccagtagcacggttcaactggtaatggaaaatggtcaggtctacccgattaaaggcacgctgcaattttccgacgttaccgtagatgaaagcaccggctctatcacgctcagggcggtgttccctaacccgcaacacagtctgcttcccggtatgtttgttcgcgcccgcattgatgaaggcgtccagcccaatgccatccttgtcccccagcagggcgtaacccgcacgccgcgcggcgacgcaatggtgatggtggttaacgataaaagccaggtcgaagcccgcaatgtcgtggcggcgcaggctattggcgataaatggctcatcagcgaagggttaaaaccgggcgataaggtcatcgtcagcggcttacaaaaagcgcgaccgggcgtccaggtgaaagccactaccgatgctcctgcagcgaaaacggcgcaataaggtaaccgtacatggcaaacttttttattagacgtcctattttcgcctgggttctggccattatcctgatgatggctggcgcactggcaataatgcaacttcccgttgcgcagtatccaaccattgcgccgccagcggtttctatttctgcaacctatcctggcgcggatgcgcagacggtacaggatacggttactcaggttatcgaacaaaatatgaacggtatcgataacctgatgtatatgtcctctaccagcgactctgctggtagcgtgaccatcaccctgaccttccagtccggaaccgatccggatatcgcgcaggttcaggtgcaaaataaattgcagctcgccacgcctttactgccgcaagaagtccagcagcaggggattagcgttgaaaaatccagcagcagctttttgatggtcgccgggttcgtctcagataatccgaacactacccaggacgacatctctgactatgtcgcctctaacattaaggattctatcagccgtctgaatggtgtgggcgacgttcagctatttggcgcacagtacgccatgcgtatctggctggatgcgaatctgctaaataaataccagctcacgccagttgacgtcatcaaccagttaaaagtacagaacgaccagattgcggcaggccaactgggcggcacgccagcattaccgggccagcagcttaacgcctcaatcatcgcccaaacgcgtctgaaagatccggaagagttcggcaaagttacgttgcgcgtcaataccgacggctctgtcgtccatctcaaagatgtcgcgcgtattgagcttggcggtgaaaactataacgttgtagcgcgcattaacggtaaaccggcctccggtctcggtattaaactggcgaccggcgctaacgcgctggataccgcaaccgcaatcaaagtgaaactggcggagctgcagcctttcttccctcagggaatgaaggtggtttatccttatgacacaacgcccttcgtaaaaatatctatccacgaagtggtaaaaacgctgtttgaagcgattattctggtgttcctggtaatgtatctgttcttacagaatatccgggcaaccctgattcctaccatcgctgttcctgtcgtgttgctaggcacttttgcggtactcgccgcctttggctattccatcaataccctgacgatgtttggtatggtactggcgatagggctgttggttgacgatgcgatagtggtcgtagaaaacgttgaacgtgtaatgatggaggataacctttctccccgagaggcgacggaaaaatccatgtcgcagattcagggagcgctggttggtatcgcgatggtactgtctgcggtatttatcccgatggccttttttggcggctcgaccggggcaatttatcgccagttctctattactattgtttcagcaatggcgctatccgttctggttgcgttgattctgacgccagcactgtgcgctacgctgcttaaacccgtatctgctgaacatcacgagaaaaaaagcggcttctttggctggttcaataccaggtttgaccacagcgttaaccactatactaacagcgtaagcggcatcgtgcgtaatacgggtcgctatctcattatctatctacttattgtagtcggaatggcggttctgtttttacgcctcccgacctccttcctgccggaagaagatcagggagtattcctgaccatgattcagctcccctctggcgctacgcaagaacgtacgcagaaagtgctggatcaagtcactcattactacctgaataatgaaaaagcgaacgtcgaaagcgtgtttaccgtaaacggctttagctttagcggtcagggacaaaactcagggatggcatttgtcagccttaaaccctgggaagagcgtaacggtgaagaaaatagcgtcgaagccgttatcgccagagcgacacgcgcctttagccagattcgcgacgggttggtgttccccttcaacatgccggcaattgtcgagttaggtaccgcaacaggtttcgacttcgaactgattgatcagggaggactcggtcacgatgcgttaacaaaagcgcgtaatcaactcctgggtatggtcgcgaagcatcctgatctattagtgcgcgtacgcccgaacgggctggaagacacgccacagttcaagctggatgtcgatcaagaaaaagcgcaggcgctcggcgtttcgctgtctgatatcaacgaaaccatctccgcggcgttgggcggctattacgttaacgactttatcgatcgcggacgagtgaaaaaagtatacgttcaggctgacgctcagttccgtatgctgccgggagatatcaacaatctttatgttcgcagcgctaatggcgagatggtgcccttctctacctttagctcagcacggtggatttatggttcgccacgcctggaacgctataacgggatgccgtcaatggaactgctcggcgaagcagcacccggacgaagcaccggtgaagccatgtcgttaatggaaaacctggcttcacagctaccaaacggtattggctatgactggacaggtatgtcgtatcaggaacggttgtcaggtaaccaggcgccggcgctgtacgcaatctcactcattgtcgttttcctctgccttgccgctctgtatgaaagctggtcaattccgttctcggtaatgctggtcgtaccgctcggcgtggttggcgctctgcttgcagcgtcattgcgcggtctgaacaatgacgtttacttccaggttggcttgttaaccactattggcctttctgctaaaaacgccatcctgattgtcgagttcgccaaagatctcatggaaaaagaaggacgtggattgattgaagcgacgctggaagcatcccgtatgcgtttacgtcctattctaatgacctcgctggcctttattctcggggtaatgccgttagttatcagtcgtggcgcaggtagtggtgcacagaacgcagtaggcacaggggttatggggggaatgttaaccgcaaccttattagctatcttcttcgtgccggtattcttcgttgttgtaaaacgccgatttaatcgccatcatgattaaccggtaaacagaggcgtcttcggacgcctttttaaacggtacgtctttatctccgctattccccctctccgcttacctctgcattctccatagtttttacaattcacatgaattgagatgattcctcatgtcggccattttttctgtggtggtaaaataactctcgttttcgcagcggttagagccagcattacgttgctgtacttcgcgaaacgctgattaatgaggtaacaccatgaaaagactaattccagttgcattgcttaccaccttattggcaggttgtgcacatgattctccctgcgtaccggtttatgacgatcaagggcggctggttcataccaatacatgtatgaaaggtacaacgcaggataactgggagacagcaggcgctattgctggcggcgctgcggcggtagcagggttgacgatgggtatcattgcgctttctaaatgatacatgcaggcgcggcaatgccgcgctttcagtaataatataaaggtcgtaaggatactcagcgacgtaatctgttcagcctgtcccccgaaagttaacacgataaaacgctctcttttcttactcgcccatcccgatggtatttattctattccttgtccgatgcagacaaaattatagcttgatagcatcgtaagccgcattacaaacaggctttatacagtaagacttagagcgtgatcattaggcgtaattattacagacagtctggatataaaccggaacatacacgtaatacatgaggattttgagcactgtccctaggccaaactggcaaataaaatagcctaatgggccagatttttagtcctcagcgaatatctctattgcttattagaggcgtaagtaaaagccgtttgtacatctacttcagcacggttcacattcgatggttcaggcggatatatggtgggaaatcacgttgactaaaacggtttttatccactctacgaagatgtttaaaacgcgtcggcgtcattatccgataactttttccatagagagataaatgcaaaaaggcccagtctttcgattgggccctttgctttatttgatgtctggcagtttatggcgggcgtcctgcccgccaccctacgggccgttgctgcgcaacgttcaaatccgctcccggcggatttgtcctcctcaggagactactcaccgacaaacaacagataaaacaaaaggcccagtctttcgactgagccttttgttttatttgatgtctggcagttccctactctcgcatggggagaccccacactaccatcggcgctacggcgtttcacttctgagttcggcatggggtcaggtgggaccaccgcgctactgccgccagacaaattctttttcaaataccgaactttaaccgtattaagtggtgctgatacccagagtcgaactggggacctcacccttaccaagggtgcgctctaccaactgagccatatcagcacactaaatttgatgcctggcagttccctactctcgcatggggagaccccacactaccatcggcgctacggcgtttcacttctgagttcggcatggggtcaggtgggaccaccgcgctagtgccgccaggcaaattctgttatcagaccgtttttacgttctgatgtaatctgaatcagtgctgaaaatcttctcttaaccgccaaaacatcttcggcgttgtaaggttaagcctcacggttcattagtaccggttagctcaacgcatcgctgcgcttacacacccggcctatcaacgtcgtcgtcttcaacgttccttcaggagactctaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggtccacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaggagcttcgcttgcgctgaccccatcaattaaccttccggcaccgggcaggcgtcacaccgtatacgtccactttcgtgtttgcacagtgctgtgtttttaataaacagttgcagccagctggtatcttcgactgacttcagctccatgagtaaatcacttcacctacgtgtcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcgtcacgcctcagtgttaaagtgaaccggatttacctggaacacacacctacacgcttaaaccgggacaaccgtcgcccggccaacatagccttctccgtccccccttcgcagtaacaccaagtacgggaatattaacccgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacgacacaccttcacaggcttacagaacgctcccctacccaacgaacgtatccctaagccaactcgactttaatgaacgctttgacgtcgcttcgctccgtcaatcgtcaactccgtaaagttgtcttgggtgatacgttcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagccgggatggccccctagccgaaacagtgctctacccccggagatgaattcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccggttaagactcggtttccctacggctcccctatacggttaaccttgctacagaatataagtcgctgacccattatacaaaaggtacgcagtcacacaggtaaacctgtgctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcacatgcgcttttgtgtacggggctgtcaccctgtatcgcgcacctttccagacgcttccactaacacacatgctgattcaggctctgggctcctccccgttcgctcgccgctactgggggaatctcggttgatttcttttcctcggggtacttagatgtttcagttcccccggttcgcctcattaacctatggattcagttaatgatagtgtgacgaatcacactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttcttacgattcatcatcgtgttgcgaaaatttgagagactcacgaacaactttcgttgttctgtgtttcaattttcagcttgatccagatttttaaagagcaaatatctcaaacgtgactcgtaagtcagttttgagatattaaggcaggtgactttcactcacaaaccagcaagtggcgtcccctggaggtttgacctcatcagtttgaacgctggcgtcccctaggggattcgaacccctgttaccgccgtgaaagggcggtgtcctgggcctctagacgaaggggacactgaagtctcaatcgcaagacgccttgctattcacttttcatcagacaatctgtgtgagcacttcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccgacctaatcgctggcaacaaaggataagggttgcgctcgttgcgggacttaacccaacatttcacaacacgagctgacgacagccatgcagcacctgtctcacagttcccgaaggcaccaatccatctctggaaagttctgtggatgtcaagaccaggtaaggttcttcgcgttgcatcgaattaaaccacatgctccaccgcttgtgcgggcccccgtcaattcatttgagttttaaccttgcggccgtactccccaggcggtctacttaacgcgttagctccggaagccacgcctcaagggcacaacctccaagtagacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcgaatgcagttcccaggttgagcccggggatttcacatccgacttgacagaccgcctgcgtgcgctttacgcccagtaattccgattaacgcttgcaccctccgtattaccgcggctgctggcacggagttagccggtgcttcttctgcgggtaacgtcaattgctgcggttattaaccacaacaccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttacctcaccaacaagctaatcccatctgggcacatctgatggcaagaggcccgaaggtccccctctttggtcttgcgacgttatgcggtattagccaccgtttccagtagttatccccctccatcaggcagtttcccagacattactcacccgtccgccactcgtcagcgaagcagcaagctgcttcctgttaccgttcgacttgcatgtgttaggcctgccgccagcgttcaatctgagccatgatcaaactcttcaatttaaaagtttgatgctcaatgaattaaacttcgtaatgaattacgtgttcactcttgagacttggtattcatttttcgtcctaggacgttaagaatccgtatcttcgagtgcccacacagattgtctgataaattgttaaagagcaggtgcgacgcggcttgcagctcaccgtcgcgaggtggcgtatattacgctttcctctttcagagtcaaccctgaatttcaggatttttctcttcaaccgaccggctgtttgtgtgaagtgattcacatccgccgtgtcgatggaggcgcattatagggatcccatttttttgcacaagcgttttttggatctttttttctgtttgttgatttttcatccctttcgctccattcctgcgcaaagtggcgattttttgatgctatctccccttgcacaacgccgttaaagcaaccaaagtcttcatgactattcatttatgatgaggtagacatgtctgacacattacgtccttataagaatctttttcctggtatcggtcagcgcgtgatgatcgataccagcagcgtggttattggcgatgtccgtctggcggatgatgtcgggatctggccgcttgtggtgattcgcggcgatgtgaattacgttgcgataggggctcgtacgaacattcaggatggcagcgttcttcacgtaacccacaagtcttcatccaatccacacggcaacccattaatcattggcgaagatgttaccgttggccataaagttatgctgcacggctgtaccatcggtaaccgcgtactggtcggtatgggctccattgtgctggatggcgcgataatagaagatgacgtaatgattggcgcgggaagcctggtgccgcagcacaaacggctggaaagcggctatttatatcttggcagtccggtaaaacagatccgccccttgagcgatgctgagagatcgggcctgcagtactccgccaataactatgtaaagtggaaagacgactatctttctcaggataaccatatccaaccgtgatcatcttcctgctgggccaggattaatgcttccgcctcttcttccaggtcccagcgatactcacgaaaaatggccagccattgctccgctgtttctccaccaaagcgatacgccagtacatctttttttattgcacacgtgagttgcatcccattaaccagggcgggaaagatgatagcactggcggcagtatcccattcttcgcggtcaggaaattgtatggcctggttcacgctaataattcctgctgtagctgctcaatcactggctcgacctgcggtaatacaccgtgccaaagcaaaacggcatgtgcagcctgccccaccagcattcccagcccatctgcgtagcgttttgcgccctgttgtacacaccaggagagaaatggcgtattccctttttgatagaacatgtcatagcaacagagggaagggtgaataagtgacgctggtatcgccgggatttcgccccgtatgccgctggaggtcgcattaataattaggtcaaactcacaaccatccagcttgtccatatccgtggcatgaacgctgccggtatgagcaaagattttcgccaacgcttcggcacgtgaagctgtacggttggtgatagtgaccgcgcaatccaaagaaagcagaggtaacagcacgccccgggatgcgccgcccgcgccaatcagcaaaatacgcaatcctgggcggataaaatttaaacgttcgagatcgcctaataaaccgataccgtcagtattgtcgccaagcaaacgaccatcttccagccgttttaatgtattgacggctcccgccagcgatgctcgttccgttaactcatccgaacgcgcaaacgcctcctctttaaaaggtactgtgatgtttgcgccttttccccctgccgcgaaaaaggcatcaagcgtattaatgaaattattaataggggccagcacgcgaccataggggtgaacaatatctagctgctgagcaaattgctgatgaataaatggcgatttgctgtgcgcaatcggatttccaaaaacagcataggtttccatcatattacccctgtcgaaacagttcgcccgtcagagcatcgcgaatttctgaaggatttaaacgcccacccgttgcgccttcaaccaccggaaaatcatcaccaaattgcgcacgcacctcttcaacggtacggcatggcggtaatccgctcagattggcgctggtggaaaccagcggtttgccatacgcattgcatagcgcgaccaccagcgggtggttggtaacacgaacggccagggaatcaaaacgtcccgtgagccaccgcggcgttgtcgcgggcgcaggaaaaacaaacgttaccggcccgggccagcaatcaaataccgctttacgctgtgcggcggtaagtatgctgtcatcaatataaggttttaactgctcaaagctggcggcaatcaaaatgagtcccttatcgacgggccgttgttttaacgccagcaggcgcgtaacggctgtttcactatcgggatcgcagccgacgccgaaaacggcttctgttggataagcgatgacattttctttattcaggagatctaccgctgcggcgatagatcctattggcaggttattattcacttgtttattccaccggaaccggctttccacattgtttactggcgcaaaagcgcttcacgccctgcgcggttttcttttcgatgagtagcggataatggcactcggggcattcccctgcaaccggtgtgaagttaatgacaaactgacattccgggtagcgatcgcaggaatgaaagattttaccgtaacgagaacggcgctggaccaaatgtccttgctggcaggctggacaggcaatcgccgtttcatccggtttatcaataaccactgtatgttcacattgcggatactgactgcatccgatgaacatgccaaagcgcccctgacgcaacaccagcacggcgccacactcagggcacagttgcccctccagaattttaacgatatgtccgtccgcctgacttttcagcggacgaacgtaatcgcattccggatagcgagaacagccgagaaacggaccatgtttcccggaacgaattaccagttcggccccgcactgcgggcagggctcatttttacgcaccgaaaacagtgctgatttagccatattcactcatgcagcattaacacctatcaatgcagcataccttcatttacctcaaagagtaattcttccatttgctgataggcgttttcacagcccggaatgttgaataacaccatcaaaataacccatttcaagtcttccaggtcaaactctgcggtatccagcgccagcacacgctcaatcaccatttctcgtgtttcgaggtttagcacctgaatctgctcaaggaataacaggaacccccggcaactggcatcaagcctttcacactcttcaaccgtataaatgcgcattgaaagagggtcggaagcaagttgcatgggttccgcgaggccatcctgatagtcagcgagtttttccagccacagcagcgcattgtagatgtcttcgcgatcaaacccagcgtcggtgagatcacgctccagtctgtcctgatccacgcgcagctcggcttcgttatggatgtatgtttcaaacaaatacattagtacgtcgaacatggcttgccctccttaatcggacatagccgccgggtacagctgcgatccatcctgctaactccagttcgagtagctgagccactaccgctggcacaggttggccggcacgttcagcgacgacgtcaacaggtgttacctcatctcctacgttagccaggagctcaggaaatggcaatgccgcctcatcctgatttagtgaataaagtgaattttccgccgtagttggcaaccagtgtaagccgtattgcaaattttccagaatatcctccggcgtcgtcacaagcgtggccccttgtttaattaaccagtgcgtgccttcgcttcccggactaccgataggacctggtaatgcaaaaacgtcccgcccctgttcaagcgcgcagcgcgccgtcaccaacgaaccgctgcgcaacgccgcctcgattaccagcacgcctttgctcagtccgctgatgatacggtttctgcgaggaaaatgttgcggtagcggaggcgttgaaagcggaaattctgagaccactgcgccgccggtggcaatcaagttttcagccagcatggcatgtcggcgaggataaatctttgccaagccattccctaacaccgctacactttttccccccatactcaccgcggcgttgtgtgctacgccatcaattccccgggcaaggccgctggtgatcgtcaaaccgcttttcgcaaggctttcgcaaagcagacgtccccagcgttctccataccaggagtggctccggctccctacgacggcaagttggcaggtatgcagacaggcaggatcgccgtcaataaaaatagcgccgggataatcgtcaatagcacgcagttggggaggataaatctcactatccgcacacagaaaatggtgctgcggtagttcaagccagcgtaatgtctcatcaagcacacctgctggaagctgtaaaaaacgttcagcttgccgcgcggtaagaccagcctcctgaaggtgcgtgcgatttatctgaggctggcgaataagcgagttcgccatgttcaacatcgcctcgccataaaggtcgccgacgtacattaaacgtaaccaaatttcggtacgggccatcctttccctcccctgccacaagcagtctgaacaatctttgcgattggtcactgatgctgtcaatcaggtggggatttgtctagaatagaggtaataatcttttcaactcctgaacacaactctggataattatgtcagttttgcaagtgttacatattccggacgagcgccttcgcaaagtcgcaaagccggttgaagaagtgaatgcagaaattcagcgtatcgtcgatgatatgttcgaaacgatgtacgcggaagaaggtatcggtctggccgcaacgcaggtcgatatccaccagcggatcatcgtgattgacgtttcggaaaaccgcgacgagcgcctggtactcattaacccggaattgctggagaaaagtggcgaaacgggtatagaagaaggctgtctgtcgattccggaacagcgcgctttagtgccgcgcgccgagaaagtgaaaatccgcgcgctggatcgcgacggcaacccgtttgagcttgaagcggatggtttgctggcaatttgcattcagcatgagatggatcatctggtcggtaaactgtttatcgattatttgtcgccgctgaagcaacaacgtattcgtcagaaagtagaaaaactcgaccgcctgaacgcccgggcttaaaggacaagaaccaacgtgtcagattcactacgtattatttttgcgggtacacctgactttgcagcgcgtcatctcgacgcgctgttaacttctggacataacgttgtcggcgtatttacccaacccgatcgtccagcaggtcgcggcaaaaagttgatgcccagcccggtaaaagtgctggcggaagaaaaaggcctgcccgttttccagcccgtgtcgcttcgtcctcaggaaaaccagcatctggtggctgacttacatgccgacgtcatggttgtcgtagcatatggtctgattctcccaaaggcagtgctggatatgccccgtctcggatgtatcaacgttcacggttcgctgcttccacgctggcgcggcgcggcgcctattcagcgctcactctgggcaggcgatgcggaaaccggcgtcacaattatgcagatggatgtagggctggataccggcgacatgctgtataaacttgcgtgcccgattaccgcagaagataccagtggctcactgtataataagttggctgaacttggcccgcaggggttaattaccacactaaaacaactggcggacggcacagcgacgcctgaagcgcagaatgaagcgctggtcactcatgcggaaaagctcagtaaagaagaagcgcgtatcgactggtctctctccgcagcacagctggagcgttgcattcgcgcctttaatccgtggccaatgagctggctggaaatcgacggccagccggtaaaagtctggcaggcgtccgtcattgaggacgccacgcagtcgctgccgggaaccattctggccgcgacgaaacagggcattcaggttgcaacaggcaaggggatattaaatttgctttcgcttcagcctgccggcaaaaaagcgatgagcgcccaggatctgttaaattcacgccgggaatggtttattcctggtaaccgtcttgcctgacggtcacgtctttataagcccggtgttaccgggcatttttattttatacatatgaaaaaacaaaacaatttacgtagtctggcagcacaggccgttgaacaggtcgtcgagcagggacaatcattaagtaatgtgctcccgccgctgcaacaaaaagtcgccgataaagacaaagcgctacttcaggagctgtgctttggcgtactgcgcaccctttcacagctggaatggctgatcaataagctgatgtctcgtccaatgaccggcaagcagcgtacagtgcattacttaattatggtcggcttttatcagttgctgtacacccgcgttcctccccatgcggcgctggctgaaaccgttgaaggcgcggtctccatcaaacgtccgcagttgaaagggttaattaacggcgtcctgcgccagttccagcgccagcaggaaacgttgcttaatgagtttgcgaccagcgatgcgcgctttttacatccaggttggctggtaaagcgtttgcaaaatgcttaccccacacagtggcaacacattattgaagcgaataaccagcgtccaccgatgtggctacgtgtaaatcgtacacaccacacccgcgacggttggcttggcttacttgaagacgcaggcatgaagggatatccccatcccgattatcccgacgctgtacgtctggaaacgccagctccggtacatgctttacccggttttgctgagggttgggtaactgtccaggatgcctctgcgcagggatgtgcggtttttctcgctcctcagaacggtgagcacattttagacttgtgcgccgcgcccggcggtaaaaccacgcatattctcgaagtggcccccgaagcagacgtgttggcagttgatattgatgaacaacgactctcccgcgtttacgacaacctaaagcgtcttgggatgaaagcgacagttaaacaaggggatggacgttatccctcccaatggtgcggcgagcagcagtttgaccgtattctgctggatgcgccctgctccgcaaccggcgtcattcgccgtcatccagatatcaaatggctgcgtcgcgatcgcgatatcgcggaactggcgcaattacaggcggaaattcttgatgccgtctggccgcgcctgaagcccggcgggacgctggtttacgccacctgttccgtactgccggaagaaaaccgcgatcagatcaaaacctttttacaacgcactcccgatgccgcgctcagcgaaacgggaacacctgatcagccaggacaacagaatctgccgggcggcgaagaaggtgatgggttcttttacgctaagctaatcaagaagtgatgagataacgggccacgactgatgaaaattatcatactgggcgcagggcaagttggcggaacactggcggaaaacctggtcggcgaaaacaacgacatcacggtggttgataccaacggcgaacggttacgcagtttgcaagataagttcgatctacgcgtagttcaggggcatggttcgcatccccgcgtgttgcgcgaagcgggcgctgacgatgcggatatgctggtcgctgtcaccagttcagatgaaactaatatggttgcctgccaggtagcctattcactcttcaacactccaaaccgtatcgcccgcattcgctccccggactatgttcgcgatgcggataaactctttcattctgaagcggttccgattgatcatctgatcgcgccggagcagttggttatcgataatatttatcgcctgatcgagtatccgggagcattacaggttgtaaactttgccgaagggaaagtcagtctggcagtagttaaagcctactatggcggtccactaataggtaacgcgctctcgacaatgcgagagcatatgccgcatatcgatacccgcgttgccgcaattttccgccatgacagaccaatccgtcctcagggctcgactatcgtggaagcaggggatgaagtcttctttattgcggcttcacagcatatccgtgcagtaatgagcgaattacagcgtctggaaaaaccctacaagcgcatcatgctggtgggcggcggcaatatcggcgccgggctggcaaggcgtctggaaaaagactatagcgttaaattgatcgaacgcgatcaacaacgcgccgcagaattggctgagaaactgcaaaacacgatcgtcttttttggcgacgcttccgatcaggaattgctggcggaggagcatattgatcaggtcgatctctttatcgcggtcactaacgatgatgaagccaatatcatgtccgcgatgttggctaagcggatgggcgccaagaaagtgatggtgttgatccaacgtcgcgcttatgtcgatcttgtgcagggtagcgttatagatattgcgatttctccgcagcaggccaccatctctgcattactgagccatgtgcgtaaagcggatatcgtcggcgtttcctcactacgtcgcggggttgccgaagccatcgaagccgtcgcgcacggcgatgaaagcacttcccgcgtggttggccgcgtcattgacgaaattaaactgccgccaggcaccattattggcgcggtggttcgcggtaatgatgtcatgatcgctaatgacaatttgcgcattgaacaaggcgatcacgtcattatgtttttgaccgataaaaagtttattaccgacgtcgaacgtctgttccagccaagtcctttcttcctctaatttaaggggcgctcattcagcgccctttttaattccctttatttatcaaggtttaatttatttcgctaaacagaagccgtaaatggaaaatgccttagcatttgttaaacttataacgtcagctgcatagggagaataaaaatgagttttattaaagaatttcgcgaattcgcgatgcgcgggaatgttgtggatttggcagtgggtgtcattattggcgcggcattcggtaagattgtttcttcactggttgccgatatcattatgccgccgttgggattgttaatcggcgggatcgactttaaacaatttgcttttacgttacgcgaagcgcagggagatattccggcggtcgtcatgcattacggcgtgtttatccagaacgtatttgattttgtgattgtggcctttgctatctttgttgccattaagcttatcaacagactcaaccgtaaaaaagcagaagagccggcagctccgccagcgccttctaaagaggaagtgttattgggcgaaatccgcgatctgctgaaagaacaaaataaccgttcttaataagcagaaggccagtggtaaaaaagtgattcactttcttgccactggcctcccagttccctcgattaccgtgtttacctttacgcagataacttcctttgcctttcttatttttttcaacgcgttgcctgaaaaggggatcgtgcagtaatgcctcgatggcattgtcctttatctgccctttcttatgttgataacgactcataatgtctcccgattgtataaattaacggcgcgagtgtagccccgccggttcaataaatcaacatcccgatttcgctccactggccccctgttccagggcttccagaatggaacaatagacgctactgtgggccgttccgcaacaagcatcattaagcctttgtaacgaacgctgcatcgtttgcagttccgcaatcctggcttcaacctcctgcaatcgctcttgcacaatactttttgactcctgacaggtatggtgctcaggatcaattcggatcgataaaagctcgcggatcgagtcgagcgtgaaacccaactgccgcgcataacgaataaacttgagacgctgcagatcgttttcggtatacagacgaaacccgccttcagtacgtacctcatgatccatcatctgttgcttttcatagtagcgaatggtatcaggcgttacgtctgccagctttgccagctcaccaatgcgatacatacaagctccgttaattatcgttgattttatgcagcagtttttctgcatactcaccgtgtaaaaagtcggtactcaacccagcctgccgaagttttagttcaagcagcgagagctggcgactaacctgatggtatcgagggtcatcttcccggatactgttgaggatatcaagtaactgaatagcatctctgcgctgctccagttcagggggaagacagcccgcattcttgagtaagcgataacccgcacgaagttccgccggcacatgagaatcatcatccagaataagcggctcgccacggccaggcaaattatcaaactcgcctttacgctgtgcctcgataatatgacgctctgcccactggtcaagtaaccacatacgtcgctccagggattgaacgaaaagaatacaattattgtagatatgtggggttcaggagggtataaaaaaacccgccgaagcgggtttttttacgttactacagattactctgcagcagcttctgttttctctgaacgatcaaccagctcgatgtatgccatcggcgcgttgtcgcctgcacggaagccacacttcagaatgcgagtgtaaccaccggcgcggctcgcgaaacgcgggcccagctcgttaaacagttttgccacgatctcgttatcacgagtacgggcgaatgccagacgacgattagcaacgctatcagtcttggcaagagtaatcagcggctcaactacgcgacgcagctctttcgctttaggcagggtcgtcttgatgatttcatgacgaaccagtgaacctgccatgttgcggaacatagcctggcgatggctgctgttgcggttcagttgacgaccactcttacgatggcgcatgaccttatccttctcagtaaaaccttaacctgtgatccggttactcgtcagcgatgcttgccggtggccagttttccaggcgcatacccagagacagtccacgggaagccagcacgtctttaatctcggtaagagattttttacccaagttaggcgtcttaagaagctcaacctcggtacgctgtaccagatcaccgatatagtggatagcttctgccttgaggcagttagcagagcggacagtcaattccagatcgtcaacagggcgcagcaggatcggatcgaattctggtttctcttctttcacttccggttgacgtacatcacgtaaatcaacgaaagcttccagttgttcagccaggatggttgccgcacgacgaatcgcctcttcaggatcgattgtgccgttggtttccatttcgatgaccagcttgtccaggtcggtacgctgttctacacgcgctgcttcaacattgtaggcaatacgctctacagggctgtagcaggcgtcgaccagcagacggccgattgggcgctcatcttcttccgaatgaattcgggtagaagccggcacataaccacgaccgcgctgaactttgatacgcatactaatagacgcgttttcatcggtcaggtggcagatcacgtgctgcggcttgacgatttcgacatccccatcatgggtgatatcggctgcagtcacagggccaatgccagatttattcaaggtaagaataacttcatctttaccctgaactctcaccgccagccctttcaggttgagcaggatttccaggatgtcttcctgaacgccttctttggtgctgtactcatgtagtacaccatcaatctcaacctcggtcaccgcgcaacccggcatcgatgagagcagaatacggcgcagtgcgttacccagagtatggccgaagccacgctctaaaggctcaagggtcaccttggcgtgcgtcgaactcacttgctcgatatctaccaggcgcggttttagaaactctgtcacagaaccctgcattgtgtcctctctttggtactaagctttacttggagtaaagctcgacgatcaggtgttcgttaatgtccgcagacagatcagaacgctcaggcttacgcttgtacgtaccttccatcttgccagcatcaacttccagccaggttggcttttcacgctgctcagccagctccagagcggctttcacgcgagactgcttcttcgctttctcacgaatgctaacaacgtcattcggactaacctgataagaagcgatgttaacaacacgaccgtttaccataattgctttatggctaaccagctgacgtgcttctgcacgagtggcgccgaagcccatacggtatacaacgttgtccagacgaccttccagcagagccaacaggttttcaccggtgttgcctttcagacgtgctgcttctttgtagtagttacggaactgacgctccagcacaccgtaaatgcggcgaactttttgcttttcacgcaactgcacaccatagtcagacagacgcggcttacgcgcaccgtgctggccaggagcttgttcaattttacacttggtatcgatcgcgcgaacgccagacttaaggaataagtcggtgccctcacgacggctcagcttgagcttaggacccaaatatcttgccattttctttctccaactaacctggaaaacgaagcgttatacgcgacgttttttcggcggacgacaaccgttatgagggatcggagtcacatcagtaatattagtgatgcggaaaccagcggcgttcagagcacgaatagtagattcgcggcctggacccggacctttaaccataacttccagattcttgataccgtattctttcacggcgtcagcgcaacgctctgctgcaacctgagctgcaaacggagtggatttgcgagaaccacggaaaccggaaccaccggctgttgcccaacccagcgcattaccctgacgatcggtaatagtcacgatggtgttgttgaaagaagcatggatatgagccacgccgtcagagacttgttttcttacacgtttacgtgcgcgaactggtgcctttgccattattcaatcaccccgattatttcttgatcggtttgcgcggacccttacgggtacgagcgttggtcttggtacgctgaccgcgaaccgggagaccacgacgatgacgcaaaccgcgatagcaaccaagatccatcaggcgcttgatgctcatgctgatttcacggcgcagatcaccttcaacgacaaatttggcaacttcgtcacgcagcgtgtcgatttgttcttcagacagctcactgatcttaacattttcagcgatacccgctgcagccaggatggctttagaacgggtcttgccgacaccgtagatcgaagttaacgcgatcacggcgtgtttctgatcaggaatgttaatgcctgctatacgggccactatgcactcctactatttaatatgtacgtaccatgctgaaaagcccgttttcaggatactcaaatggaaacgtacagacatacaaaagattggctggctaatctagccagctcaacccaactttgcaagaaaaatatgcgaaaaaatcagccttggcgctgtttatgcttcggctcggcactgcaaatcacacggatgacaccatcacgcttaacgattttgcagttacggcataatttcttgacggaagcacgaactttcatttttactctccgtaacttctcaggcgaccaattaacggccgtagcctttcaggttcgccttcttcaatgcagactcatactgactggacatcatcagagtttgcacttgagccataaagtccataatcacgacaacaacgataagcagtgaggtcccaccgaagtagaacggcactttcattgcatcacgcatgaactccgggatcaggcagataaaggtaatatacagcgcaccaaccagggtcaggcgggtcattactttatcgatatacttcgccgtttgctctcccggacgaattcctggtacaaatgcaccggacttcttcaggttatctgctgtttcacgcgggttgaaaaccaacgccgtgtagaagaaacagaagaagatgattgcagacgcatagagtaacacataaagcggttgcccaggctgcaaatacagcgaaattgttgtcagccagttccaaccagtaccgcccccgaaccatgacgcgatggtcgccgggaacagaataatactggaagcgaagattgccgggattacccccgccatattcactttcagcggtaaatgtgtgctctgtgcagcatagacacgacgaccttgctgacgtttggcgtagtttaccacaatacggcgttgaccacgttcaacgaatactacaaagaacgtcactgcaaatactaatactgcaaccaacagcaacacgaggaagtgcaggtcgccttgacgcgcttgctcgatagtatgggcaatggctggcgggagtcccgcaacgataccagcgaagatgatgattgagataccgttaccgataccgcgctcagtaatctgttcgccgagccacatcaggaacatggttcctgtaaccagactgacaacagcggtgaaatagaatgcaaagcctggattcatcaccaggccctgcataccaggcatattcggcaaaccggtagcaataccgatcgactggaatatcgccagcaccagagtaccgtaacgggtgtactggctgatcttacgacgaccagactccccttctttcttaatttctgccagcgttggatgaaccaccgtcaacagctggataatgatcgacgccgaaatatacggcatgatccccagggcaaagatagaagcacggctgagagcaccaccagagaacatgttaaacatttcaatgatggtgcctcgctgttgctcaagcagtttggcaagtacagcggcatcaataccagggatcggaataaaagagccaatacggaacacaatcagcgcgccgataacaaacagcagtctgcgtttcagctcacctaagccacctttggcactttgaaaatctaatcccggttgtttagccatctgctacttattcctcgattttaccgccagcagcttcgatagcagcacgagcgcctttagtaacacgcaggccacgaacagttaccggagtagtgacttcgccagccaggatcactttcgcgaactcgatctggataccgataatgtttgccgctttcagcgtgttcaggtctacaacgccgccttctactttcgccaggtcagacagacgaacttcggctgtaatcgctgctttgcgagaagtgaagccgaatttcggcagacgacggtacagaggcatctgaccaccctcgaaaccgcgacgtacgccaccgccagaacgagacttctgacctttgtgaccacgaccaccggttttaccgaggccagaaccgataccacgacccaggcgtttacccgcctttttggagccttcggccggagacagagtatttaaacgcatctcttactcctcaactttaaccatgaaggaaaccgcgttgaccataccacgaacagcaggagtatcctcgcgctctacggtgtgaccaatacgacgcagacccaggccaagcagcgttgccttgtgtttcggcagacgaccgattgcactgcgggtttgagtaattttaatagtctttgccatggtttatttccccagaatttcttcaacggatttaccacgcttggcagcgaccatttctggagaattcatattttccaggccatcaatagttgcacgaaccacgttgatcgggttggtggaaccgtatgctttagccagaacgttatgaaccccagcaacttccagaacggcgcgcattgcaccaccggcgatgataccggtaccttcggaagctggctgcatgaatacacgagaccccgtgtgaacacctttaaccgggtgctgcagggtgccgttgttcagcgcgacgttaatcatattgcgacgggctttttccatcgctttctggatcgctgctggaacttcacgcgctttaccgtaaccaaaacctacgcgaccgttaccatcgcctactacagtcagagctgtgaaggagaaaatacgaccacctttaacggttttagatacgcggtttaccgcgatcagcttttcctgcagttcgccagcttgtttttcgatgtgagccatcttacacctctaccttagaactgaaggccagcttcacgggcagcatctgccagtgcctggacacgaccatgatattggaacccggaacggtcaaaggacacatctttgatgcctttttccagagcgcgttcagcgacagctttacccacagctgcagccgcgtctttgttaccggtgtacttcagttgttcagcgatagctttttctacagtagaagcagctaccagaacttcagaaccgttcggtgcaattacctgtgcgtaaatatgacgcggggtacgatgtaccaccaggcgagttgcgcccagctctttgagcttgcggcgtgcgcgggtcgcacgacggatacgagcagatttcttatccatagtgttaccttacttcttcttagcctctttggtacgcacgacttcgtcggcgtaacgaacacccttgcctttgtaaggctcaggacgacggtaggcgcgcagatctgctgcaacctggccgatcacctgcttatcagcgcctttcagcacgatttcagtttgagtcggacattcagcagtgatacctgccggcagctgatggtcaaccgggtgagagaaacctaaagacaggtttactacattccctttaaccgctgcacgataacctacaccaaccagctgcagcttcttagtgaagccttcggtaacaccgataaccattgagttcagcagggcacgcgcggtaccagcctgtgcccaaccgtctgcgtaaccatcacgcggaccgaaggtcagtgcattatctgcatgtttaacttcaacagcatcgttgagagtacgagtcagctcgccgtttttacctttgatcgtaataacctgaccgttgattttgacatcaacgccggcaggaacaacgaccggtgctttagcaacacgagacattttttcctccgattaggctacgtagcagataatttcgccaccaagaccagcctggcgcgctgcacgatcagtcataacacctttagaggtagaaacaactgcgatacccagaccggccataactttcggcagctcatctttacgtttgtagatgcgcagacctgggcggctgacacgctgaatgctttctacaacagctttaccctggaaatacttaagagtcagttccagttccggcttggtgtcgccttcaactttaaaatcttcaataaaaccttcttccttcagcacgttggcaattgccactttcagcttggaggaaggcatggtgaccgcagctttgttcgcggcctgaccgttacggatacgggtcagcatatccgcgatcggatcttgcatgctcatctgtctttactcccgtgattcaattggtgacaattaccagctagcctttttcagacccggaatttcaccgcgcatagcggcttcacggaccttaatacggctcaacccgaacttccgcaggaaagcgtgcggacgaccagtttgacggcagcggttacgctgacgtgacgggctggaatcacgcggcagagtctgcagcttaagaaccgcattccaacgatcttcgtcggttgcgttcacatcagagatgatcgctttcagttcagcgcgtttcgcgaagtatttatcagctaaagctacgcgttttacttcgcgtgctttcattgattgcttagccatttagtaaccctaccttacttgcggaacgggaagtcaaaggcagccagcagagcacggccttcttcgtcagatttcgcagtagtggtaatggtaatatccaaaccacgaacgcggtcgactttatcgtagtcgatttctgggaagatgatctgctcacggacacccatgctgtagttaccacgaccgtcgaatgacttagcggacaagccacggaagtcacggatacgaggaacagcaatagtgatcaggcgctcaaagaactcccacatgcgttcgccacgcagagttactttacagccgatcggatagccctgacggattttgaagcctgcaacagatttgcgtgctttggtgatcaacggtttttgaccggagattgctgtcaggtctgctgctgcgttatccagcagtttcttgtcagcgatcgcttcaccaacacccatgttcagggtgatcttctcgacccgagggacttgcatgacagaattgtagttaaactcagtcatgagtttgttaactacttcgtctttgtagtaatcatgcagtttcgccatcgtactactccaaattacttgatagtttcgctgttagacttgaagaaacggacttttttgccgtcttcgaatctaaagcctacacggtcagccttgccggttgccgcattgaagattgcaacgttagaaacctgaattgcagcttctttttcaacgatgccgcccggttggttcagagccggaaccggcttctggtgtttcttaaccaggttgataccttcaacaatgaccttgccggaagacaggacattcttaactttaccgcgtttacctttatctttaccggttaacacgataacttcgtcatcacgacggattttcgctgccatgattcgctccttagagtacttctggtgccagagagataattttcatgaacttctcgttacgaagttcacgagttaccggcccaaaaatacgcgtaccgataggctgctcgctgttattgtttaaaataacgcatgcattaccatcgaagcgaatgacagaaccgtccgggcgacgaacacccttcttggtgcgcaccactaccgccttcagcacatcaccttttttgaccttaccacgcggaatcgcttctttgatggtgatcttaatgatgtcgcctacgcctgcgtagcgacggtgcgagccacccagaaccttgatacacattacgcgacgtgcaccggagttgtcggcgacgttcagcatagtctgttcttggatcattttagtgctccgctaatgtcaactactactgagacccgaaaatcaggtcgttaaaaaaaccccatatcgagggcgcggcattataacaccgcaaatcagatatgggtagaaaaaataaacggcccatcgctgagccgtttattcgttgagaatgcgtactgtattacagaaccgctttctctacaacgcgaaccagagtccaggatttggtcttggacagcggacggcattcgcggatttcaaccacgtcgccgataccgcattcgttgttctcgtcatgtacgtgcattttggtcgtacgcttgatgaatttaccgtagatcgggtgtttcacaaaacgttcgatagcaacaacaatggatttctccattttgtcgctaaccacgcgaccttgcagagtacggattttatcggtcattacgcacccgccttctcagtcagtaaagtcttaacgcgtgcgacatcacgacgcacttgcttcaacaggtgagactgttgcagctggccacttgcagcctgcatacgcaggttgaactgctcacgcagcaggttcagtagctcggtgttcagctcttcaacgctcttctcacgcagctcttttgctttcattacatcaccgtcttagttacaaaggtggttttaatcggcagtttcgctgctgccagcttgaatgcttcacgggccagctcttccggtacgccgtccatttcatacaggactttacccggctgaatcaaggcaacccaatactccacgttacctttacctttacccatacgcactgccagcggcttttcagtgatcggtttgtccgggaatacacggatccagatcttaccttgacgcttaactgcacgggtcatagcacgacgtgctgcttcgatctgacgggcagtcagacgaccacggccaacagctttcaggccgaagctgccgaagctaacatccgcgcctgcagccagaccacggttgcggcctttgtgcattttacggaattttgtacgctttggttgtaacatcagcgacgctccttatttacggcctttacgctgctgctttttcggttgagcagccggtttttccggttgttcaacagcagccataccacccaggatctcgcctttgaagatccacactttaacgccgattacaccataagtggtgtgcgcttcagaggtgttgtagtcgatgtcagcacgcagagtgtgcagcggtacgcgaccttcgcggtaccattcggtacgtgcgatttccgcgccgcccagacggccgctaacttcaactttgatacctttagcgcccagacgcatggcgttctgtacagcacgcttcatcgcacgacggaacataacgcgacgttccagctgagaagtgatgctgtcagcaaccagtttagcgtccagttcaggtttacgaacttcggcgatgttgatctgtgcaggaacgccagcgatatccgctacgaccttacgcagtttttctacgtcttcaccttttttaccgataacgatacccgggcgagcggtgtgaatagtcacacggatgctcttagccggacgctcgataacgatacgagatacagacgctttagccagttccttcgtcaggtactgacgtactttaaaatcgctgtccaggttgtcagcgaattctttggtgttcgcaaaccaggtagagttccatggttttacaatacccaggcgaataccattaggatgtactttctgacccattgctagtctccagagtctcagcgatcggacacaaccacagtgatgtggctggtgcgcttcaggatgcgatctgcacgaccttttgcacgcggcataatgcgcttcatgctcgggccttcgtctacgaaaattttcgtaactttcagatcgtcaatgtcagcgccatcgttgtgttcagcgttagcaatggcagattccagaactttcttgaccagtacagccgctttcttgttggtgtaggtcagaatatccagagcctgcgacactttcttaccgcgaatcaggtcagcaacaaggcgaaccttctgagcagaagaacgagcatggcgatgtttagcgatagtttccatctcttcctcctaccttatttcttcttcgcttttttatcagcagcgtggccgcgataagtacgagtcggtgcgaattcacccagtttgtgaccgaccatttcgtcggaaacaaataccggaacgtgctgacgaccattatggacagcgatggtcaaaccgatcatgttaggaaagatcgttgaacgacgggaccaagtgcgcaggggcttcttgtctccgctttccaccgctttctctaccttcttcagcaagtgcaggtcaataaaaggacctttcttgagagaacgtggcatggcttatcctctaaaattatttgctacggcgacgtacgatgaatttatcagtacgcttgttgctgcgggtcttcttacctttggtctgaacgccccacggagttaccgggtgcttaccaaagttacgaccttcaccaccaccatgtgggtggtctactgggttcatcgcagtaccgcgaacggtaggacgaacgccacgccagcgtgcagcacctgctttacccagaacgcgcagcatatgctcagcattgccaacttcgcccagggttgcacggcagtctgcttcgactttacgcatttcaccagaacgcagacgcagggtgacataagcgccatcgcgagcaacgatctgaacgtaagtaccagcggaacgtgccagctgaccgcctttacctggtttcatttctacgttatgaacggtagaaccaaccgggatattgcgcatcggcagggtgttgcctgctttgattgcagcatcaacgccagactgaatctggtcgccagctttcaggcctttcggggccaggatgtaacggcgttcgccgtctttgtacagaaccagcgcgatgttcgcggaacggttcggatcgtactcaagacgttcaacaactgccgggataccgtctttgttgcgtttgaagtcaacaatacgataagcctgtttgtgaccaccaccgatatgacgagtggtgatacggccattgttgttacgaccaccggatttgctgtttttttcaaccagcggagcaaaaggtttgcccttgtgcagctctgggttgaccactttaacgacgtggcgacgacccggagatgtcggtttacatttaacaactgccattgtattactcctccgacttactcagcgccgccgacgaagtccagattctggccttctttcagggtgacgtaagcttttttccagtcgctacgacgaccgatacgctgtccgtgacgtttaactttccctttaacgaccagggtgttaacgacttcgacttcgacttcaaacagtttctgcacagcagctttgatttctgctttggtcgcgtctttagcaactttgagaacgatggtgttggttttttccatcgcagtagacgctttttcagaaacgtgcggtgcgcgcagcaccttcagcagacgttcttcacgaatcatgccagcatctcctcaacttgcttaacagcatcagcagtcattacgactttgtcgaaggcgatcaggctaaccgggtcgataccagtcgcatcgcgtacgtcaaccttgtgcaggttacgtgcggccaggaacaggttctcgtccagctcaccggtgatgatcagcacatcttccagagccatgtctttcagtttctgtgccagcagcttagttttcggcgcttctacagaaaacttctcgacaacgatcagacgatcctgacgtaccagttcggacaggatgcttttcagcgcgccgcggtacatcttcttgttaactttttgactgtggtcctgcggacgagcagcgaaggtcacgccaccggaacgccagatcgggctcttgatagaacctgaacgcgcacggccagtgcctttctggcgccacggttttttaccggaaccagttacttcagcacgagtcttctgagcacgagtaccctgacgagcaccagctgcataagcaacaacaacctggtgaaccagcgcttcgttgaaatcacgaccgaaggtagtttcggaaacagtcagcgcgctctgcgcgtctttcaatactaattccattgctatccccttacgccttcacagctggtttaacgatcaggtcgcaaccggttgcacccggaacaccacccttaaccagcagcaggttgcgctcagcgtcaacgcgtactacgtcaaggctctgaacggttacgcgctcattacccatctgacctgccattttcttgcctttgaacactttgcccggagtctggttctgaccgatagaccccggaacgcggtgagacaaggagttaccgtgagtagcgtcctgggtacggaagttccagcgcttaacggtaccagcgaaacctttacctttagaggtaccggttacgtcaacttttttaacgtcagcaaacagttcaacgctgatgctctgacctacggtgtattcttcgccttcagccagacggaattcccacagaccacggccagcttctacgccagctttagcaaagtgacccgcttccggcttggtgacacggttagcttttttagcacccgtagtaacctgaacagcgcggtagccatcgttagccaggtctttaacctgagtaacacggtttgcttcaacttcgattacggttactgggatagagacgccatcttcagtgaagatgcgggtcatacccacttttttaccgactaaaccaatcattgtatcaacctctcaatcgctcgatgacctgattaacccaggctgatctgcacgtctacaccggcagccaggtccagacgcatcagagcatcaacggttttctcggttggctcaacgatgtcaaccagacgcttgtgagtgcgaatttcgtactgatcgcgcgcatctttgttaacgtgcggagagatcagaacggtaaagcgctctttgcgggtcggcagcgggatcggaccgcgaacctgcgcaccagtgcgcttggcagtctcgacgatttccgcggttgattgatcgatcagacgatgatcaaacgctttcaggcggatacggattctttggttctgcatgagaccagagctccaattattttataaacgaaaatgattactcctcacacccattacgattgatgggagagtgtaaccgttcttacgtagctccccgattgggagcattgttaaatagccaaatcggctattcgaggttcaaatcgaacctgccgtcaattacgacaagcccgcgcattatacgtaaatctcagcctgacgcaagtgtcggatagaaattaagcgctttattcttatgcgagcacgattccagatggtacgcatgggatggcgacgcgcatcttttctttggaaggcatcaggcaaacctggcaatacgtcgttgtcgctgtcgcataaatctataaaggtgagcgcaagccttgacgaggatttgcttatgtttgttgccctcccctttctcattttttatgcgtcgttctctttattacttggcatatacgacgcgcgtaccggtctgctgcctgaccggtttacttgtccattgctgtggggtggtctgctttatcaccagatttgcctgccggagcgtttaccggatgcgctttggggcgctatcgccggctatggcggattcgcgttaatttactggggctatcgcctgcgttatcagaaagaggggcttggatatggcgacgtcaagtacctcgctgccttaggggcgtggcattgttgggaaacactgccgttactggttttccttgccgctatgttggcctgtggcgggtttggcgtcgcgctactggtgagaggtaaatcggcattaataaacccgctaccttttgggccatggctggcggtggcgggtttcataacaggttggaaagttttctttccagacggttaatcggtaaccttaatttgtgattgcagataattttgcataccaagtttggcaatcaaatccaactcagtttccagccagtcgatgtggccttcctcgtcggcaagaatttcaatcatcatatcccggctgacataatcatgaacgctatcggcataggctattgcctcacgtagatcttttgcgccttccagttcgagccggagatccgatcgtagcatctcttcgacatcttcaccgatgcccagcttgcccagatcctgtaggttcggtatgccttccagaaataaaatacgctcaatatacttatcagcgtgtttcatctcatcaatggattcatggtactcaacatcattaagccgggtcagcccccagtttttgaacatacgggcatgaagaaaatactgattaattgcgacaagctcatttcccaatagtttattgagataatttatgattttaacatcacctttcattttatagtccctccgcttccactctctagagcgtagatggggctacagggatgtcaaaaaaaagagtgtgactcaggcgatctctttaaattccggcatttgcgttaactcatcctgcatcacttctcgcgcggcgcgaatacacttaccacattgatttcccacaggaataaatttacgcaactgttgaaatgactgtggatgaaattgtcgtacagcctggcggatttttttatcgcttataccattacacaaacaaacgtacatgatcgctcccgttcaatttccgcacaaagtgtaaatgagaatggttatgattacaatagcacaaagcgatttacgccacgggagaagcgttaaaaagggtgaataaatataacagcggctaaatagcaggcaacaaaaagggcgccgaagcgccctcttcaattcaaaactaattaacgagtaattagcccagaactttagcaacaacgcccgcgccaacggtacggccgccttcacggattgcgaaacgcagaccgtcgtccatcgcgatcgggtggatcagggtaacaaccattttgatgttgtcgcccggcattaccatctctacgccttccggcagttcgatggtaccagtcacgtcagtagtacggaagtagaactgcggacggtagcctttgaagaacggagtatgacggccgccttcatctttggacagaatgtacacttcagattcgaacttggtgtgcggcttgatggtgcccggcttagccagtacctgaccacgttcgatttcttcacgtttgataccacgcagcagaacacctacgttctcaccggcacggccttcgtccagcagtttgcggaacatttcaacgccagtacaggtagacttctgagtctctttgataccaacgatttcaacttcttcgcccactttgatgataccgcgctctacacgaccggtaacaacggtaccacgaccggagatggagaatacgtcttcgatcggcagcaggaacggcttgtcaatcgcacgctctggttccggaatataagaatccaggaagccagccagttcgatgattttcgcttcccactctgcgtcgccttccagcgctttcagagcagaaccacgaacgatcggagtgtcgtcgcccgggaagtcgtactgagacagcagttcgcgaacttccatctcaaccagttccagcagctcttcgtcatcaaccatgtcgcatttgttcaggaacacgatgatgtacggaacgcctacctgacgacccagcaggatgtgctcacgggtctgcggcatcgggccgtcagtcgcagcaacaaccaggatcgcgccgtccatctgagcagcaccggtgatcatgtttttaacatagtcagcgtgccccgggcagtctacgtgtgcgtagtggcgggtcggggtatcgtattcaacgtgagaagtgttgatggtgataccacgcgctttttcttccggcgcgttatcgatctggtcgaatgcgcgagcggcaccgccgtaggttttagccagtacggtagtaatggcagcggtcagcgttgttttaccatggtcaacgtggccgatagtaccgacgttaacgtgcggttttgtacgttcaaatttttctttagacacggctatattccttactatagcgctctccccttcaggagagagcacgggattttggtttttaaccctgcggcttatttaccacgggcttcgattacggcctgagcaacgttgttcggcgcatcatcatacttcaggaattccatagtgtacgatgcgcgacctttggtcagagaacgcagctgagttgcatatccgaacatttcagacagcggtacttcagcgtggatcttaacgcctgtaacttcagattcctgacctttgagcataccacgacggcggctaaggtcgccgataacgtcaccggtattctcttcaggtgtttctacttcaaccttcatgatcggctcaagcagaactggttttgctttcttaaagccttctttaaaggcgatagacgcagccagtttaaacgccagctcagaggagtcaacgtcatggtaagaaccgaagtgcagacgcacaccgagatcaactaccggataaccagccagcgggccagatttcagctgctcctggatgcctttatcaacggccgggatgtattcgccaggaattacaccacctttgatgtcgttgatgaactcgtaacctttcgggttagagcccggctccagcgggtacatgtcgataacaacatgaccatactgaccgcgaccaccagactgtttcgcgtgtttaccttcgatgtcggtaactttcgcgcgaatcgcttcgcggtaagcaacctgaggtttacccacgttagcttcaacgttgaattcacgcttcatacggtcaacgatgatatccaggtgaagttcacccataccagcgatgatggtctggttagattcttcatcagtccatacgcggaatgacgggtcttctttcgccagacggcccagagccagacccattttttcctggtcagctttggttttcggttctaccgcgatggagattaccggctcagggaattccatacgttccagaatgatcgggttttccggatcacacagggtgtcaccggtagtcacgtctttcaggccgatagcagccgcgatgtcgcccgcgcgaacttctttgatctcttcacgtttgttggcgtgcatctgaacgatacgaccgaaacgctcacgtgcggttttcacggagttcagtacggtatcaccagagttaaccacaccggagtacacacggaagaaggtcaggttacccacaaacgggtcggtagcgattttgaacgccagcgcagagaacggctcgtcgtcgcttgcgtgacgctcagccggagtatctttaccgtcgtccagaataccgttgatcgcaggtacgtctaccggggatggcaggtaatcaattaccgcatccagcatcgcctgaacacctttgttcttgaatgcagaaccacaggttaccaggatgatttcgttgttcagaacgcgctgacgcagagcttgtttgatctcttcttcagtcagttcttcaccacccaggtatttttccatcagctcttcagaagcttctgcggcggactcgatcaggttctggtgccattcgttagccaggtcctgcatgtcagccgggatatcttcgtattcgaaggtaacgccctggtcggcatcgttccagttgatggctttcattttcaccaggtcaacaacgccggtgaaaccttcttcagcaccaattgccagctgcagcggaaccgggttcgcgcccagacgggttttgatctgaccaacaactttcaggaagttcgcgcccatgcggtccattttgttaacgaacgcaatacgcggaactttgtatttgtttgcctgacgccatacggtttcagactgcggctgaacaccaccaactgcgcagtaaaccattaccgcaccatcgagaacacgcatggaacgttctacttcgatagtgaagtcaacgtgccccggggtgtcgatgatgttgatgcgatgcggttcatactgcttagccataccagaccagaatgcagtagtcgctgcggaggtgatagtaataccacgctcctgctcctgctccatccagtccatggtagctgcgccgtcatgaacttcaccgattttgtggtttacaccggtgtagaacagaatacgttcggtagtagtggttttaccggcgtcgatgtgcgcactgataccgatattacggtagcgtgcgatgggtgttgtacgagccatttgattcctcgttgatatctttaggcgttcagttaagttatccaaaacgggcgacttacctgaagcgcccgcctggtgactatgactccgaagggattaccaacggtagtgtgcgaacgccttgttggcttctgccatacggtgaacgtcttcacgtttcttaactgcagtacctttgttgtctgcagcatcagaaagttcgttcgccaggcgcagagccatggatttatcaccgcgtttacgagcagcttctacgatccaacgcattgccagagcattacgacggaccggacggacttcaactggtacctgataagtagaaccacctacacggcgggatttaacttctacagtcgggcgaacgttttcgagagcgacttcgaaagcttccagttcagatttaccagaacgctgagccagggtctccagcgcgctgtatacgattgattctgcagtagattttttaccatctaccatcaggatattgacaaatttagccagcagttctgatccgaacttcggatccggcagaattttacgctgaccaatgacgcgacgacgtggcatggaaatactccgttgttaattcaggattgtccaaaactctacgagtttagtttgacattaatttaaaacgtttggccttacttaacggagaaccattaagccttaggacgcttcacgccgtacttagaacgagcttgcttacggtctttaacgccggagcagtcaagcgcgccacgaacggtgtggtaacgaacacccgggaggtctttaacacgaccgccacggatcaggatcacggagtgctcctgcaggttgtgaccttcaccaccgatgtaggaagtcacttcaaaaccgttagtcagacgaacacggcaaactttacgcagtgcggagttcggttttttaggagtggtagtatatacacgagtacatacgccacgtttttgcgggcatgcttccagcgcaggcacgttgcttttcgcaactttgcgagcacgtggtttgcgtaccagctggttaactgttgccattaaatagctcctggttttagcttttgcttcgtaaacacgtaataaaacgccctcacacaatatgaggacgccgaattttagggcggtgtcgaaaaggtgtcaagaaatatacaacgatcccgccatcaccaggccatctggttggcatacttaaccgtgagtctgacaaactcagtatagtcaaccctgacgacactgtctgaaatttgaccacccaggccgcgggcgtcaatgtcttctttcaaggcatagaccgttatgggggcatcgcgcagactttcaaggaagcggttaccttcaatcgcgacggtaacgccatcctggagcagcaaaagcgcatcgccctcttttagcaggcgcagcaaagcgggaaaatcaacgctcgaagcgcaatgaggtaaggtatgcagcataaacgcctcagaatctcaggatgacatcatagttgccaagctcgcggcgtaacgccacgggttccagcggcgtggcgtctaccacaaaattaatgttctccagaccacgctcgcgcagcgatgccgcgcagatccagcattgatcaatatcgtacaaatcaaagagcttgaaagtagcaatatagtcacgcgccagtacagcgtctggtttttgtccgggtaataactgaaagacgccgtcgctgataaaaaagacgcccagcgcttccgttagcgctgacgtcgccagcagcgcatccagcccttcacgacctgaggcgctgccgtgcggcgcggtggaaaagacaaatgcaatacgtttcattaaaactgcaccacccgatcgcaggtgagagatgcctccgccagcgcgcccaggccgcttagcgtaaagcccggctgaagattggcggacggcaacgccaatctgccggcttcagtttcatcaataataccgcgacgaagcgccgccgcgacacagatgttcagcgctacgccatgctgcgtattcaatttctgccaggcgcgtaccagatcatattcatcgctcgccggcgaggtcaggagattggcgttatagacaccttcccgatagaaaaagacgctggctaactcatgcccctcattgagcagcgcgtgggcgaactgcaatgcgctgctggcctgctgggtgccatatgccggcccggtgaccataatggcataacgcattatttatcctgcccctgaaagtcgccgcttttgaactggcgaatatagaggtaaaccgtgtgttttgagatattcagacgatcggctacctggttaatggcgtctttaatatcgaaaatgcctttttcgtacaggttaaggacgatctgacgatttttcgcattgttagaaacattacgatcggcattcacttcttcgatcgtgaactccagcgtctgggtgactaaatcttcgactgaggaggcaaaattaaccgctgagccgacttccggcgtttccggcggaataaaggtattcataatctgtgaaaatggcacatcgagattcatgttgatgcacagtagaccaatgacgcgctgctcgcggttgcgaatggcaatcgtcaacgacttcatcaagacaccgcttttcgcgcgcgtgaaatagcatttcgacacgctactgtccgcccctgtcatgtcgtgcaacatacgcaacgccaggtcggtaatcggcgagccaattttacggcccgtatgttcgccattggcaatacgaatggctgaacattttagatcctgcaaagagtgcaatacgatttcacaatgggaacctataagcatcgctaacccgtccactaccgcttcgtaggatttcagaatatcgaagtcggtttgctcgaagggacgctgatccagcaaatcaagttcactggtttcgttggttaaaagcgacctggacatgaaaaaaaacactccttttcaggagcctgtcgttatgttttcagggcaggctcattatttacgcggatgattaaattaatacagtgagggttcatctttccagtactaatttgctcgtctatttcagactacgtgtgcgttggcggtcattcagcctacggtctcgcccttaacgaccagcgcaagcgccgttatccgcaaatcaaattatggtgagtaatatatccggcctgaataaaaaaaaccgccgctattacaagcggcggctctcagtttttattttttagcagcatctgcggctttagcgtcagccgcatcggcaggtttagcatccgctttcggcgctggtttgatatccagcagctctacgtcgaataccagggttgagtttgccgggatccccggaacgcccgttttaccgtaggccagctcaggtgggataaccagcttgatcttgccgcctttcttaatatttttcagaccttcagtccagccagggataacgccgtccagacggaaggagagcggttcgccgcgcgtgtaagagttatcaaactctttaccgtcgatcagagtacctttgtagttcaccacaacggtatcgctatctttcggcgcctcgcctgtgccttctttctctactttgtaaagcaggccggtagaggaggttttcacacctttctctttagcaaaagcgtcgcggaacgttttaccttttgcttcgttatcggcagcgtctttttccatcttcgcctgagcagcgctcttcacgcgtgcttcaaacgtctgcagcgtttgctcaatttcctgatcggacagtttgctcttatcggcaaaggcatcctgaacgccggcaatcaactgatctttatccagtttgatgcctaacttttcctgctctttaagcgaattttccatgtaacgacccagcgaggcgcccagcgcataagccgctttttgatcgtcgtttttaaatgctgctttgctatcagcggtagctgccggtttcgccgcatcagcagcaaaagtgatcggtgcgtgcatagcaacggccatcgtagttgccagcagcgtggctttaaacagtgatttcatccatatctccagggccggggcatctcgccccatgttaacttacgtaagaagcgtactataaatcgttgcagaacaaatcaacatacgaacacgccctattatcacttcttttcagactctttttgtttaaattagtttcgtagtgcgcgtaatggttgctgtgaaagccggtaaagttaagtagaatccgccgacggagacaacataaagaggtacatcatgcaggatatcacgatggaagctcgtctggctgaactggaaagccgtctggcgttccaggagattaccatagaagaactaaacctgacggtaaccgcacatgaaatggagatggcgaagctgcgcgatcatctgcgtttgctcacggaaaagttaaaagccagtcagccgtcaaatatcgcctctcaggcagaagaaacgccgccgccgcattattgagacgaaaaaaagcggggttaacccgctttttttgtgcccgatgatttatcgaaccaatgataataccctaaggatttcgagtcacagcaaggctgcaagcttgaaaattccccgggagcatagataactatgtgaccggggtttgaaagcgtagccaacaccgcggtggcttgaaagacgacggggattaatggcagccgcagccgcctttaccaccaccgccgcagcagccttcgccgccgtgctcgtgaccatggtcatgaccatgaccgccacagcagccgtcttcaccgtgatcgtggtggtgatcgtgcgcgccatgaacatgaccgtgagccagttcttcttcagtcgcttcacgaatcgcaacaacttctacgttaaatttcagattctggcccgccagcatgtggttaccatcaaccacaacgtgatcgtcttccacttcggtaatctctaccggtaccgggccctggtcggtttccgccaggaaacgcatccctacctgcagttcatcaacgcccataaagacgtctttaggcacacgctgcaccagattttcgtcatactggccgtaagcgtcgttcgcgccaacagcgacatcaaatttgtcgccaacttcatggccttccagcgcggtttccagaccagagatcagggagccgtgaccgtgcaggtaatccagcggcgcactcaccggagactcatcaaccaacacaccgtcttctgtacgtacctgataggccaggctgaccaccaggtcttttgctactttcatgatatctcctgagcatgggaagaatagtggcgcagattgtagcggaattctgcagccgtgtaccccttagcttaaaaaaacctgcggcatatcgctagtccggatgaaaaatcccgatcacttgctcttctttgcgaacatgctcgcggacgtctttatccgcttcccgcatttgatgcccgcacttaacgcattcaacaatatcgacattattttcacgccacatcgccattgtatcctgcgcctgacaggccggacatttcgcgcctgcaataaaacgtttacggattgccattgttttacccctactcaaattcatcccagccatccaactggcgccgttcctgttgcatttcccgctgaaaaatctcctccagttcgcgtcgggcctctctggcgcgcgaaatctgtaccatgtcgctatgctccgggatcagttcccgcaacattcgcatatccagccgacgaaaatgcaactgcgcgcgttgcgcctgatgcggatgcatacctaacgacaccagagttttacgtcccagttccagcgcgctggaaaacgtttcacgggaaaactgcgtgacgccagcctgtaataactcatgggcctccacacgtccacgcgctcgcgcaagaatatgcagatgaggaaaatgctgctgacacagcgccaccagcttcatcgtgtcttccggttcattacacgtgatgactatcgactccgccgcttccgcgcccgcagaacgcagcagctcgacttgtgtagcgtcgccgtaatacactttataaccatatttgcgcatcagattaacggcgccgatatcgcgttccagcacggtgatacgcatcttattcgccatcaataagcgagcgatcacctgaccaaaacggccaaagccgacgacaatcacctggggcttatcatcctcaacccacggcttttcatcattctcttccgggccattaaggcggcgcgataaccacttatcaatccctttcatcagtagcggcgtggtcatcattgataatgtgacagtcaccaataataacgccatctgatcgccctgaaacaggcgctgagaagaggcggtagaaaagagcacaaaagcgaactcgcccccctgactcagcacgctggcaaactgcatccgttcagaacttcttattccatatagccgcgccagcagatacagcgtcaacatttttatgacgaccagaataacaacgctcgccgccacccacagtaaatgggtataaagtacgccgagatttagcgacataccgacggagataaagaacagcccaagcagtaaacctttaaagggatcgatagcattttccagctcatgccggtattcgctctctgccagtaaaacgccggcaatgaaggttcccagggccatcgacagtcccagcgcatccataaataaggcggcgctcaacaccagcaacagcgtcgcggcagtgaagacctcccgcacgccagacgcagcaataaaacgaaataccgggcgcagcaggtaacgaccgccaatcagcattaccgcgaaagccagtaccttcattgccactttaaaccagtcgaaatgctcgtcggccgatcccgccaataaaggcaccaacgccagtgcggggatcaccgctaaatcctgaaacagtaagacggaaaaccctaactgcccggactcgctacgattcatgcctttctcgcgcatcagttgtagcgccatcgccgtcgaagacatcgccaggccaatcccgccgacgaccgccgcctgccataagaaatcagcaagcatcaataatcccgccagcaccgccgcgcttaacagcacctgagcagcgccgacgccgaagatagagcgccgcagttgccaaagccgggacggattgagttcgagaccaatgataaacatcagaaacacgacgcccagttcggaaaagtgcaggatctcgtcaacgtcgctgataaatcccagcccccacggaccgatggcgattcccgccagcaaataccctagcaccgcgccgatgcccagcctggcggctaacggcaccgccgctaccgctgcgaagaggaacaacactcccgcggtcaataaatcagcaccttccatcaatagcctcccgcgctcacaggattcgccagccactcgccataggctttcgcatgactggccagcgtctgcggcgactggcggcgcgcccagtacacaataatgggcggcatccagtgcatccggcacatggccgcggtcagttcaaaagggcggagtacatcgctcattggatagcggtttagcgcgtcataccggtaagcgctctccggctcgccggtcgtaatcacgctacgccagtactttcccaccagttggtttccccctggtccgctggcgaacccccgactcaaaacgcgatcaagccattctttcagtaaagccggacagctataggtgtaaaggggatgctgaaaaacaatgacgtcgtgctcacgtaacagggcttgttcatagggcgtgtcgataaaaaaatcaggatagcgcgcataaagatcgtgcacggttacgttattgtgctgtatggccggtttaagcagtacccggttagcaaccgagtcctgagattccggatgggcatacaacagcaagactttcgctggctgagacatcaatccccctcccggttgttttgggtcgatacatgccattcttcaggccgcttctacgttgacagcgtttgttcaactcaggaacgtactctatgtccgccgctggggattaatgagagatattcttgtccctcaccaaaggcggcctgaatgattttgtgtatcgttgttgttttgagctaccattgcgctccagcgcggcggtacgcccgaatattacattatcataatgataaattaacatagtctgaacatacggcgccttatgattgttttctcctcgttacaaattcgtcgcggcgtgcgcgtcctactggacaatgcctcggctaccattaatccaggccagaaagtcggcctggtgggtaaaaacggctgcggtaaatctaccctgctggcattgctaaaaaatgaaatcagcgccgatgccgggagttttaccctgcccggaacctggcaattagcgtgggtgaatcaggaaacacctgcgttgcctcagccagcgattgagtatgtcattgacggcgaccgtgaataccggcagctggaggcgcagcttaacgacgccaacgaacgtaacgacggacatgctatcgcctccatacatggcaagctggacgccatcgacgcatggaccgttcgttcgcgcgccgccagcctgctacacggtctcggcttctctaacgatcagctggaacgtccggtcagcgacttttccggcggctggcggatgcgccttaacctggcccaggcgctgatttgccgttccgatttactgctgctcgacgaaccgaccaaccacctcgatctggatgccgtcatctggctggaaaaatggctgaagagctatccgggcaccctgattctgatctcccacgatcgcgactttcttgacccgatagtggataaaattatccatatcgaacaacagactctgttcgagtacaccggcaactacagcgcgtttgaagttcagcgcgccacgcgcctggcgcaacagcaggcgatgtatgagagtcagcaggagcgtgtggcgcatctgcaaagctacatcgaccgtttccgcgctaaagcgaccaaggccaagcaggcgcaaagccgtatcaagatgctggagcgtatggagctgattgcgccggctcatgtcgacaacccgttccatttcagcttccgcgcgccggaaagcctgccgaacccgctgctgaagatggaaaaagtcagcgcaggttatggcgatcgcatcattctggaatccatcaagctgaacctggtgcccggctcgcgtatcggcctgctgggtcgcaacggcgcggggaaatcgacgctgatcaagctgctggcgggcgaactggaaccgttgcacggtgaaatcggcctcgccaaaggcattaagctcggctacttcgcccagcaccaactggagttcctgcgcgccgatgaatccccgctgcaacatatggcgcgtctggcgccgcaggaactggagcagaagctgcgcgactatctcggcggcttcggtttccagggcgacaaagtaacggaagagacgcaacgtttctccggcggcgagaaagcgcgcctggtactggcgctgatcgtctggcagcgtccaaatctgctgttgctcgatgaaccgaccaaccacctggatctcgacatgcgtcaggcgctcaccgaagcgctgattgatttcgaaggcgcattggtcgtcgtgtcgcacgaccgccacctgattcgctccaccactgacgacctctatctggttcacgacaaaaaggtcgaaccgttcgacggagacctggaagattatcagcaatggctgagcgacgtgcagaaacaggaaaaccaggccgacaacgcgccgaaggaaaacaacgccaacagcgctcagtcacgcaaagatcagaagcgtcgcgaagccgagctacgcactctgacgcaaccgctgcgtaaagagattacccgtctggaaaaagagatggaaaagctcaacgcccaactggcgcaggcggaagagaagcttggcgacagcagcctgtatgacccaagccgtaaagcggagatgaccgagtgtctgcaactgcaggccagcgccaaatccgggctggaagcgtgtgaaatggcatggcttgaggcgcaggagcagcttgagcagatgatgcagaacgactaagagcctatcccattaggctattttattcgccattttagggccgggcagtgctcgaaatcctcacgtactatgtgtacgctccggtttctgcgcgctgtccggccccaaactggcttcaacaattacgcctacggggataggctctaacgcacggggcggacgatgaacctgtctatcaccgatgacattaccttccgcaagctcaccatcttaatgatgcttgtggagaagggcaacatcgcccgtaccgccgaggcgctaaacacgctggaagagaacgttcgtggtccgctgttcgtccataaaggcctcttaggtactcgccccggtataaagattaccgttgcggtcagcagcaccggaacagaagcctgcgttatgtgatttagcggcaaaggttgccgtgatttattttcgtcagcgcgtcgttcacgccaaataatgtaaacgtcacctcatcaacgccaagatttttcagacgcgcagtgtgttttttaatataagcctgcgccgtttcttcggattcaaacaagtaaataccgccagcttgctggtttttctcgctttctgtccagattttccagatgaagcccggctcctcattgatagactccgccagcccgaccagttgctgagtcatctcctcgccaaaagggccgctaaagttaaaatggatctgtaaaagtgtcttcgacatgccttctccttgagtcgcataactatcgtgttgccacactaccacgattaattcggctgatgcagaggttcacgcgatttctgtggggtattgcgcgcgccttgcatactgccctctctggtgaaatgaggcgcaattttatttcgccagacgaccaattgaacgtaaaatcacatattgactaatctgtgaaccttatgcgcggtatagtattgtttccaattatcaattgttctggtgctatggttgagatcacgtccacagaaatgaccccgcctgtcaatgactcgcatgaatttattcccatgcgtggcattcgtaatcgccatttacaaactatgctgccgcgtttaatccgccgcaaagtgaagttcaacgcccactggcagcggctggagctaccggacggcgattttgtcgatctggcatggagcgaagatccgcaacaggcaaagtataaaccgcggctggtggtctttcacggtctggaaggcagcctgaacagcccctatgcccacgggctgattgaggcggcgcaaaagcgcggctggctaggcgtggtgatgcactttcgcggctgtagcggcgagcccaaccgtctgaatcgtatttaccactccggtgaaacggaggatggagcctggtttttacgctggctacagcgggagttcggcgccgttccgacagccgccgtgggctattcgctcggcggtaatatgctggcgtgcctgctggcgaaagaaggccgcgatattcccatcgaggcggcggtaattgtttctgcacctttcgttctcgaagcctgtagctaccacatggacaaagggttttcccgcgtctatcagcgttatttgcttaatctgttaaaagcgaatgcgtcacgcaagctggcggcgtaccccgggtcgctgccggtgaatctggcgcaactgaaatcaatgcgccgtattcgcgagtttgacgacctgatcaccgcgaaaattcacggctttgccgacgccatcgactactatcgtcagtgtagcgccatgccgttgcttaaccagattgctaaaccgacgctgattattcacgctaaagacgatccgtttatggatcatcatgtgatccctaaagcggaagatctgcccccgcaggtggagtatcagctgactgagcatggcggacacgtaggatttatcggcggtacgccgttgcgccctgaaatgtggctggaacgccgaattcctgactggctgacaacgtacctggaggcgtcatcatgatcattccctggcaggggctcgcccccgacacgctggacaacctgatcgaaagctttgtgttgcgcgaaggcaccgattatggtgaacatgaacgttcgcttgaacaaaaagtcgctgacgtaaaacgccaactgcaatccggcgaggccgtgctggtatggtctgaattacatgaaacggtcaatattatgccgaaaaagcagtttcgcgaataaaacgcctttgccgacaatacattattactaaagctcaatcatggagttgccatgtcagccaaacatccggtgatagcagtaacagggtcaagcggcgcggggaccaccaccaccagcctcgcgtttcgtaaaattttcgcgcagttaaatctgcacgccgccgaggtggaaggcgacagttttcatcgttacacccgcccggaaatggatatggcgatccgcaaagcgcgtgacgccgggcggcatatcagctatttcgggcctgaagccaatgacttcagcctactggaacatacctttattgagtacgggcagacgggtaaaggccagtcgcgtaaatatctgcatacctatgatgaagccgtaccgtggaatcaggttcccggcacgtttacgccctggcagccgctacccgaaccgaccgatgtgctgttttatgaaggactgcacggcggcgtcgtcaccccgcaacatgatgtcgcgcgtcatgttgatctgttggttggcgtggtgcctatcgtcaacctcgagtggattcagaaactgattcgcgacaccagcgagcgcggacactcccgtgaagcggtgatggattccgtggtgcgttccatggacgactacatcaattacattacgccgcaattctcgcgtacccatatcaacttccagcgcgtaccgaccgtcgacacgtccaatccgttcgccgcaaagggtattccctcgctggatgagagttttgtggtgatccatttccgcaatctggaagggatcgattttccctggctcctggcgatgctccagggctcgttcatttctcacattaatacattagtggtgccgggcggcaaaatggggctggcgatggagctgattatgttgccgctggtgcagcgattaatggaaggcaaaaaaatcgaataaccgcggtgaaatgcccgatggcgctacgcttatcgggcctacgagataaaaacgggtaggccggataaagccacgccgccatccggcatcacatgttacgccgcaatcacttcatacgaatgggtaatattgaccgctttttccagcattagcgccaccgagcaatatttttccgcggagagatcgacagcgcgcgcgacggcagcctctttcagatcgctgccggtaacgataaaatgcagattaatgtgcgtaaacaggcgcggcgcgtcttcccggcgctcggatgtcagcttcacttcgcagttggtgacattctgacggcccttttgcaggattgataccacatcaatagcgctacatccgccagccgccattaataccatctccatcggactcggcgctttgtcaccggagttgccatccattaaaatctggtggccggaggaggactctccgaggaacgtgagcccttcaacccactttacacgcgcttgcatatttcgtaactccaatgtttcaattttcctgaaagattacgcgcatacaacaaaagtcgcaatggaaggcgacctgggtcatgctgaagcgagacaccaggagacacacggcgaaagctatgctaaaacagacaagatgctacagtaatacattgacgtactgcatgtatgcagaggacatcacattacaggctacaatctattttcgtagcccccttcccaggtagcgggaagtatatttttgcaaccccagagacagtgccgttttctggctctggagacagcttataacagaggataaccgcgcatggtgcttggcaaaccgcaaacagacccgactcttgaatggttcttgtctcattgccacattcataagtacccgtcaaagagcacgctgattcaccagggtgaaaaagcagaaacgctgtactacatcgttaaaggctccgtggcagtgctgatcaaagatgaagaagggaaagaaatgatcctttcttatctgaatcagggtgattttattggtgaactgggcctgtttgaagaaggccaggaacgcagcgcctgggtacgtgcgaaaaccgcatgtgaggtcgctgaaatttcctacaaaaaatttcgccaattaatccaggtcaacccggatattctgatgcgcctctcttcccagatggctcgtcgcttacaagtcacctctgaaaaagtaggtaacctcgccttccttgacgtcaccgggcgtatcgctcagacgctgctgaatctggcgaaacagcccgatgccatgacgcacccggatgggatgcagatcaaaatcactcgtcaggaaatcggccagatcgtcggctgctcccgcgaaaccgttggtcgtattttgaaaatgctggaagatcaaaacctgatctccgcgcatggcaagaccatcgtcgtctacggcacccgttaattccgtcagaatggcgcgttttatcatgcgccatttttgtttgcatcgatgtggcgaagactgatttatcacccagagattaattacgcactacggcaaacgctggtgctgtgcctgcctgtggctgttggtttattaataggccagctacacctgggcttgcttttctctctcgttcccgcctgctgcaacattgcaggtctggataccccgcacaaacgcttttttaaacgcctgatcatcggcgcgtcgctgttcgccggatgcagtctggtaacgcaacttctgctggcggaatccatccccctgccgttgatcctgaccggcctcacgctggtgcttggcgtgacggcggaaattagcccgcttcacgcgcggctactgccagcatcgctgattgccgccatctttaccctgagccttgcgggatacatgcccgtctgggagccgctgctcatttatgcgctgggcacgctatggtacggcgtgtttaactggttttggttctggctatggcgcgaacagccgctgcgcgagtcattgagtttgttataccgtgaactggccgattattgcgaagcgaaatacagcctgctcacccaacatatcgatccggaaaaagcgctgcctcccctgctgatacgccagcaaaaagcggtcgatctcattacccagtgttaccaacagatgcatatgctttcggcgcacaacaataatgattacaagcgtctactacgggcttttcaggaagcgatggatttgcaggagcacatctccgtcagcttgcatcagccggaagaggtacagaaactggtagaacgcagccatgcggaagaggtgattcgctggaatgcgcaaacggtcgccgcccgtctgcgcgtgctggcggatgacattctttatcatcgtctgccgacgcgcttctccatggaaaaacagattggcgctctggagaagatcgccaatcagcatcctgaaaatccggtaggccagttctgctattggcacttcagtcgaatcgcccgtgtgctgcgtactcagcgaccgctgtacgcccgcgacctgatggccgataaacagcgtcgtttgccgctacttccggcgctgaaaaattatatgtctcttaaatcgccggcgctacgcaacgccggacgcatcagcgtgatgatgagcatcgccagtctgatgggcagtgcgttgcacctgcctaaaccgtactggatactcatgacggtgctgtttgtcacccaaaacggctatggcgcgacgcgcgtacgtattctgcaccgttcggtcggaacgctggtcggcctggtgattgccggcgtcacgctgcacttacatattcccgaaagcattacgctggcggtcatgctggtactaacgctggcaagttatctgattattcgtaaaaactacggctgggcgacggtcggctttacggtgacggcggtatacaccatccagttactgacgttaaacggagagcagtttattgtgccgaggctgatcgatacgctgattggctgtttaattgcctttggcggcatggtctggctgtggccgcaatggcaaagcgggctattacgtaaaaacgcccatgatgcgctggaagccgctcaagaagctatccgactgatcctcagtaacgatccgcaggccaccccgctcgcttatcaaagaatgcgggtcaaccaggcgcataacacgttattcaactcgttaaatcaggcaatgcaggaacccggattcaatacccactatctgtcggatatgaaactatgggtcacgcacagccagtttattgtcgagcatatcaacgctatgacgacgctggcgcgggaacacaccatgctgacgccggatctggcgcagcgctatctggaatcttgcgagattgcgattcagcgctgccagcagcgcctggagtacgacaggccaggcggctccggcgatgtcaatattctggagtcgccggacatgccgtcacatggcttattgagcactctggaacaacatttacagcgcatcatcggccatctgaacaccatgcacaccatttcgtcgatggcctggcgtcagcgtccgcatcacggtatctggctgagtaagcggctacgggatacaaaaggttaagaccgaccgccggatgcgctacgcttatccggcaatccgccatcaggccaccaccttccctaccgcctgcgcaaagcgctgcattccttcatggatatccgcctcttccaccaccagcgacggggcaaaacgcatcacgtcggctccggcattgagcaccatcacgccggcctccgcgcctgcgtacagaaaatcgcgcgcccgacctttgtacttcggcttcagttccgcgccaatcagcagccccatgccgcgaatatcgctgaaaatgtcaaattgctcgtcaatcgcctgcaaatgttgcacaaactgttgccgcttagtgtgaatgccttgtagtacctctggcgtattaataatatcgaatgccgcgccagccaccgcacaggccagcggattgccgccataggttgaaccatgcgaacctacatggaaggccgaggctatttcctgcgtggtcagcatggcgctcaccggaaaaccgccgcctaacgctttggcgctggtgaggatatccggcgtgacgccgtagtgcatataggcaaacaggtctccggtgcgccccatcccacactgcacttcatcaaacaccagcaacgcctgatgctcgtcacacaggtcgcgtaaccctttgaggaattccggtgtagccgcctgcacgccgccttcaccctgaatcggctcgaccaccaccgcgcaggtgtggtcatccattaccgctttcaccgcatgaagatcgttgaagggaacgtgaataatatcggcgggtttcggcccaaagccgtcggaatatttcggctgcccgcctacagagacggtaaacaaggaacggccatgaaaagcgttatggaaggcaatgattttcgttttgaacgggctatggcgcacgcaggcataatgacgcgccagtttaaaagcggtttcgttcgcttcggtgccggaattcataaacagcacgcgctcggcaaacgtggcgtcgatcagtttacgtcccagacgcaacgctggttcattggtaaaaacgttactggtatgccacaaggtttccccctgggatttcagcgcctcgaccagcgccggatggcaatggcccagcgcagtcactgcaatcccgccggcgaaatcaatatactctttgccctgctgatcccatactcggctgcctttacctttgaccggaataaagtccgccggtgcataaacaggcagaatcacctcatcaaaagttgcgcgcgtaatagccgtttgttcagttgccatatcattaccacccggttaagtagaaatgccagtgaaattataatcacaaaatatgaataaaaaatcactcaatagcaaccacaaatcaacgccggaggaaatttttcagcagagcgtgtccttgttcgctgagaatactttccgggtggaactgcacgccttccagatcccactcgcggtggcgaatgcccataatctcctgcgtttcgctccaggcggtgatctcaaaacactcaggcaacgtggcagggtcgacaatcagcgagtggtaacgtgtcacggttaacgggctgggcaatccccgaaacacgccctgtccattatgcgtaacaggtgacgttttaccgtgcatcactttcgctgcccgcactaccgacgcaccaaaggcctgcgccatcgcctgatgacccaggcaaacgcccagcatcggaatacgtccggcataatggcggatgaccgccagtgaaatgccagcgtcattcggcgtacaggggccaggagagataacgattttttgcgggttcaaagcgtcaatgtgcgccagcgttagcgcatcattgcgccggacctgcacttccgcgcccagttcacaaaaatactggtagaggttccaggtaaaggaatcatagttatcgataagcaggatcatggcggctccgggtgagtagaaccgcactattttactcagtttcgcgagcttcgcttatcgctttctgaaaaatcgcccgcaaagcggagagatcgcccatcgcgccgctctggttcgcctgcttccatgtttcaaccgcaataccttgccaactcagcgcgtagcctgcatgtagcgccagttgttcaaagaagatgcgctgcgccaacccgctcccaaaacgaaacggatgaagcacattaatttcacagtagtaatgcgccagccgctcgacaaacttctcgtgcgccagaccaaccaggtagccctcttcttccagatcctgcatcagagcgttgccctctttttcgatataggcaaagtggcaaaaacgggtatcgccctggtaaatatcgacctcccgcagttgccctgcccagtcgaaaatatcctgatagagctggcgatgaatcgcgcacagatgaggcaagccgcgtaccagcggccccagttcaatcgtagcggcgcggagcgcggtcatttcgtatgccgcttgcgccagtcgctgggcctgatgaatccccagccgattacgcatcacattcagccccggatagaggtacggatcgcgtccttcgccaaatttatcgctcatagtgcctccgaagctcgtcaagacgtaccagcgcttcgtcggcagtcagggttactaaggggatctcaataccttcgagacggcggctttgctggaagttaacgttgcgccgttgctcccaaaagcgtgacttttgtttatcggtaagtttcttcacctggcctccctgaatatgcctgtgcttgaccacaagtataagcagcaatttcaggttacgctgagacagggagaaaacgcgggcggctcgcacccgcgcaggcatgttttatggcaggactttcgcggaaaggataacgactggttttgtcggcacattctgataaggcccgacatcgtgcgtcggtacctgtgagattttatcggcgacatccataccttttaccactttaccaaataccgcatagccaaagtcgcgctggccgtggtcgagaaaagcgttatccgcgacgttaataaagaactggctggtggcgctgtctttatctgcggtgcgcgccatcgcgatcgtgccgcgagtattacgcagaccgttgtcggcttcattcttaataggcggattcggtttcttctgctgcatctgctcgttaaaaccaccaccctgaatcataaagccaggaataacgcggtgaaacgtagtgttgttatagaaaccactgttgacgtaatcgacaaagtttttcacagaaaccggcgctttctggctgttcagctccagctcaatattcccggcggaggtggttaacagcacatgaggatcgccttttgctgccaacgctgcgggagaaagagcagaaagagcgaaaacagctgcgacagccgccagagtcgatttgagcatgagatttccttaaagagagcagaaataaagcaagtggaatgattttaaagagccttcctgggccaggccagccctttacctaattttacgtatatgaaacaaatgtaacgttacgacgcaacgccgtattcttgcaatatgatgtgacaaacatcacattaaaaaatgcaatgaacattactatcactaataattatttaaatgcatcacaaaagcgcctaaaatctgcccgcttaacgcgccctccacgcgcttcacttctcttcaaggccagacatgactaacagcaaccgcatcaagctcacatggatcagctttctttcctacgccctgaccggggcgctggtgattgtcaccgggatggtgatgggaaatatcgcagactattttcatctgcccgtttccagcatgagtaacacctttacttttctgaacgccgggattttgatctcgatcttcctcaatgcgtggctgatggaaatcatcccgctgaaaacacagctacgctttggttttatcctgatggtgctggcggtggccgggctgatgttcggccatagcctggcgttgttctcagcggcgatgtttgtgctggggctggtcagcgggatcaccatgtcgattggcaccttcctgattacgcaactttatgaagggcgtcagcgcggttcccgactgctgtttaccgactccttcttcagcatggcggggatgatttttcctatggtcgccgccttcctgctggcgcgtagtattgagtggtactgggtctacgcctgcatcggcctggtctacctggcgattttcatcctgaccttcggctgtgaatttccggcgctgggtaaacatgcgcagcactctcaggcgcctgtcgtcaaagaaaaatggggcattggcgtactgtttctggccgtcgccgcgctgtgctatatcctcggtcaattaggctttatctcctgggtgccggaatacgccaaaggcctcggcatgagcctgaatgacgccggggcgctggtgagtgatttctggatgtcctatatgtttggcatgtgggcgttcagctttatcctgcgctttttcgatctgcaacgcattctgaccgtactggcgggtatggcggcggtactgatgtatctgtttattaccggcacgcaggcgcatatgccgtggtttattctgacgctgggcttcttctccagcgccatttatacctccatcattacgctgggatcgcagcaaacgaaagtggcctcgcctaagctggttaacttcattctgacctgcggcaccatcggaacaatgctgaccttcgtcgtcaccggcccgattgtagcgcacagcggcccacaggcggcgttactcaccgcgaatggtctgtatgcggtggtctttgtgatgtgctttgcgctcggctttgtatcccgtcatcgtcagcatagcgcgccggctacgcattgataatccttgccggatggcgacatcgccctccggcactctatcccccctcctgacggggtaggcctgttggtctaaaaacccctcattttgtatgttatttgtacaaacctgaaaagcctgacaattccgccacttataaaaatccagacaaatcagccatatacccattaagaggtatataaaggtgaatttgatttacatcaataagcggggttgctgaatcgttaaggtaggcggtaatagaaaagaaatcgaggcaaaaatgagcaaagtcagactcgctattatcggtaatggtatggtcggccaccgctttattgaggatctccttgataaatccgacgctagcctgttcgacattaccgtgttctgtgaagaaccccgtaaagcctatgaccgtgtccacctgtcatcctacttctctcaccacaccgcggaagagctctctctggtgcgtgaaggattttacgagaagcacggcgtaaaggtactggttggcgaacgcgcaattaccattaaccgtcaggagaaagtgattcactccagcgcgggtcgtaccgtttattatgacaagctgatcatggcgaccggttcctatccgtggatcccgccgattaaaggctccgaaacccaggattgcttcgtttaccgtaccattgaagacctcaacgctatcgaagcctgcgcccgtcgcagcaagcgcggggcggtggtcggcggcggtctgctggggctggaagccgctggcgcgctgaaaaacctcggcgtggaaacgcacgtcattgaatttgcgccaatgctgatggcagaacagctcgatcagatgggcggcgagcagctacgtcgcaagatcgaaagcatgggcgtgcgtgtacacaccagtaaaaacacgcaagagattgttcagcagggtaacgaagcgcgtaagactatgcgttttgccgacggcagcgagctggaagtcgatttcatcgtcttctctaccggtattcgcccccgcgacaagctggctacccagtgcggtctggccgtcgcgcagcgcggcgggatcgtgattaacgacacctgccagacgtccgacccggatatctacgctatcggcgagtgcgccagttggaacaaccgcgtttacggtctggtcgcaccaggctataaaatggcccaggtcgccgttgaccacatcctcggcagtgaaaacgcctttgaaggggcggatctcagcgccaagctgaagctgctgggcgtggacgtcggcggcatcggcgacgcgcatggccgcacgccgggcgcgcgtagttacgtttacctcgatgaaagcaaagaagtctacaaacgtctaattgtcagcgaagataacaaaacgctgctcggcgcagtactggtcggcgacaccagcgattacggcaatttgctgcaactggtactgaacgccatcgaactgccggaaaacccggattcgctgatcctgccgtcgcacgcgggcagtggtaaacccgctatcggcgtggataaactgccggacagcgcgcagatctgctcctgcttcgatgtgactaaaggcgatctgatcgccgctatcaataaaggctgccataccgtggcggcgctgaaagcggaaaccaaagccggaaccggctgcggcggctgcatcccgctggtgacgcaggtactgaacgccgaactggcgaaacagggtattgaagtcaacaacaacctgtgcgagcactttgcttattctcgtcaggaactgttccacttaatccgcgtggaaggtatcaaaacctttgaagaactgctggcgaaacacggtaaaggctacggctgcgaagtgtgtaagccgaccgtcggttcgctgctggcgtcgtgctggaacgaatacatcctcaagccgcagcacacgccgctacaggatactaacgataacttcctagcgaatatccagaaagacggtacttactcggtgatcccgcgctcggcgggcggcgaaatcaccccggaaggtctggtggccgtgggtcgtatcgcccgcgagtttaacctctataccaaaatcaccggttctcagcgtatcggcctgtttggcgcgcaaaaagacgatctgccggaaatctggcgtcagttgattgaagccggtttcgaaaccggtcacgcgtatgccaaagcgctgcggatggcgaaaacctgcgtcggcagcacctggtgccgctacggcgtgggcgacagcgtcggtttcggcgtggagctggaaaaccgctacaaaggcattcgtaccccgcacaaaatgaaattcggcgtctccggctgtacccgtgaatgtgcggaagcgcagggcaaagatgtgggtatcatcgccacggagaaaggctggaacctgtacgtctgcggtaacggcgggatgaaaccgcgtcatgcggatctgctggcagccgatctcgatcgcgacacgctgatcaagtacctcgaccgctttatgatgttctacatccgtactgccgacaaactgacccgtaccgcgccgtggctggataatctggaaggcggcatcgagtacctgaaatcggtcatcatcgacgataagctgggcctgaacgaacatctggaagaagagatggcgcgcctgcgcgcagcggtggtctgcgagtggacagaaaccgttaacaccccatccgcacaggttcgctttaagcactttatcaacagcgacaaacgcgacccgaacgtccaggttgtgcctgaacgtgaacagcatcgtccggccacgccgtatgaacgtatcccggtcactctggtggaggaaaacgcatgagtcagtggcaaaacatctgcaaaatcgatgacatcctgccgggaaccggcgtctgcgcgctgtcaggcggcgagcaggtggcaattttccgtccttaccatagcgatcaggtgtttgcgatcagcaacatcgacccgttctttgaggccagtgtgctgtctcgtgggctgattgcggaacaccagggcgaactgtgggtcgccagcccgttgaaaaagcagcgcttccgcctgagcgatggtttatgcatggaagatgagcagttttctgtgaaacattacgacgcgcgggtaaaagacggcgtggtgcagttgcgcggttaattatttttgggaggcgcaacgcctccccttttttgtattttttttcattttaattgttatcacaaaatcatttgtactgcatcgcggcggcaactgagcaacaaattcgtcaggaacgaatttgaacagccgctggctgccttcggtgagggacaaggatgtccctcattaatccccaggagcatagttcactatgtgactggggtgagcgagggcagccaacaaagaggcagtgcaaaggatgaagtgagaaaaggataatcaaatgtttacagacactatcaataagtgtgcggctaacgctgcgcgcatcgcacgcctgtcggcgaataatccgctcggcttctgggtcagttcggcaatggccggggcttatgtcggtctcggcatcattcttattttcaccctcggcaatctgctcgacccgtccgtacgtcctctggtgatgggagccaccttcggtatcgccttaacgctggtcatcatcgccggttccgaactgtttaccggccacaccatgttcctgacgctgggcgtcaaagcaggcaccatcagccacggtcaaatgtgggctatcctgccgcaaacctggctcggcaacctggtcggttccgtgtttgtcgccctgctttacagctggggcggcggcagtttattgccggtcgataccagcatcgttcactcagtcgcgctggcgaaaaccaccgcgcccgccacggtactgttcttcaaaggcgcgctgtgtaactggctggtttgtctggcaatctggatggcaatccgcaccgaaggcacggcaaaatttcttgctatctggtggtgtctgctggcgtttatcgcttccggctacgagcactccgtcgcgaatatgacgctgttcgccctctcctggtttggtcatcacagcgacgcctataccctggccggaattggtcataacctgttgtgggtgacactcggtaatactttgtccggtgtcgtattcatgggattgggttattggtatgctacgccaaaatcggagcgtccggctccggcaaaaatcaatcagccagaggctgctgccaataattaaggggtaatgtcgtggaccatttgcctatattttgtcaattacgcgaccgcgactgtctgatcgtcggcggtggcgatgtcgcagaacgcaaagcacggttactgctggaagcaggcgcacgtttaacggtcaatgcgctaacctttattccacagttcaccgtatgggcaaatgaaggcatgttgactctggttgagggaccgttcgacgaaacgcttctcgactcgtgttggctggcgatcgcggccactgacgacgataccgtcaaccagcgcgtcagcgacgcggcggagtcacgccgtatcttttgcaacgtggtggatgcgccgaaagccgccagctttatcatgccctccattattgaccgctcgccgctgatggtcgccgtctcctcgggcggcacctccccggtgctggcgcgtctgctgcgcgagaaactggaatcgctgctgccgcagcatctggggcaggtcgcgcgctatgccgggcaactccgcgcccgagtgaaaaagcagtttgccacgatgggcgagcgtcgtcgcttctgggaaaaatttttcgtcaatgaccggctggcgcagtcgctggcgaatgccgatgagaaagcggttaacgcgacaaccgaacgcctgtttagcgaaccgctggatcaccgtggcgaagtcgtgctggtcggcgccgggccgggcgatgccggactgctgacgctgaaagggttacaacaaatccaacaggcggatatcgtggtttacgatcgcctcgtctccgacgacattatgaacctggtacgccgcgatgccgatcgggtctttgtggggaaacgcgcgggttaccactgcgtcccacaggaggaaatcaaccagatcctgctgcgtgaagcgcaaaaaggtaaacgcgtggtacgcctgaaaggcggcgatccctttatctttggtcgcggcggcgaagagctggaaacgctgtgtcatgccggtattcctttctcggtagtgccggggattaccgcggcttccggctgctccgcctactccggtattccgctaactcatcgcgattacgcccagagcgtacgtctggtcacgggtcacctgaaaaccggcggcgagctggactgggaaaacctggcggcagaaaaacagacgctggtgttctacatggggctgaatcaggcagcgactatccaggaaaaactgatcgcattcggtatgcaggccgatatgccggttgcgctggtagaaaacggtacctccgtgaagcaacgcgtcgtccacggtgtgctgacgcagctcggtgaattagcgcaacaggttgaaagcccggcgctgattatcgttggtcgcgtggtagccttacgcgataaattaaattggttctctaatcattaattaaaataacgccctgttattcagggctttattttacaactactcgtaatctcaaattatttttacttaaaagtgaattaagaaactaactttaaatacaccggacaaatttaaataataattctgcctaaaaacccttttactcgtcaaattcacctcttattcattcatacaataaataacaccgttaagcactcaatttgacctgacctggttatcgggtgataaaataaacactaaagcataatttttcttctggccatttcatcattgcctgtaccgctctctgcatatgtttagtacgcaaggaaaatattaattaaggatgaaccctatgcaaaagaaaaaacttatttctatcgctatcgctttaacgctacaaagttattacattccggccatcgccgcagaaaataacgatgatgaaaaagaatgtcccagtaatatctcctccctgcctaaagaaaaacgcgcaaaactctcaccgacctgccttgctacacctgaaaatgataatcactggggctgggttgctggcggcgttgctgcattggtcgcaggtgtggctattggcgttgaaaataacggtggcggagattctaatcattcttataccccccctaagcccgataatggcggcgacgtcaccccgcccgacgatggcggcaacgtcaccccgcccgacgatggcggcaacgtcaccccgcccgacgatggcggcgatgacaatgtgaccccgcccgacgatagtggcgatgacgatgtggccccgcctgacgatagcggcgatgacgatgtaaccccgcccgacgatagcggcgatgatgatgtgaccccgcccgacgatagcggcgatggcgatgtgaccccgcccgacgatagcggcgatgacgatgtaaccccgcccgacgatagcggcgatgacgatgtgaccccgcctgacgatagcggcgatgacgatgtaaccccgcccgacgatagcggcgatgacgatgtgaccccgcccgatgatagcggcgatgacgatgtaaccccgcccgatgatagcggcgatgacgacgacacgcccccagatgactctgttattaccttcagcaacggcgtcaccatcgataaaggcaaagacaccctgaccttcgacagcttcaaactggataacggcagcgttcttgagggtgccgtgtggaattattcagaacaggacaaccagtggcagctcaccaccgcggacggtaaaacgctgaacgtcaccggctgggacgtgaccgacgccaatgccgccgtgattgaaggcacccaggaaaacggtctctactggaagtacgacagccggggctatctgattattgccgacgataacaccaccgttatcagcggcgatgaccaggcgcataattccgatcgcggcatggatatcagcggccaggatcgcaccggcgtgattatttccggcgatagaaccgtcaacacgctcaccggggactccagtgtgaccgacggtgccaccggcatggttatctccggtgacggcaccaccaacaccatttcgggccactccacggtggacaacgccaccggcgcgctgatttccggcaacggcaccaccaccaatttcgccggtgacattgccgtgagcggcggcggcaccgccatcatcatcgacggcgacaacgccacgattaagaataccggtacctctgacatcagcggcgcaggctccaccggcaccgtcattgacggcaataacgcccgcgtcaacaatgacggtgatatgaccatcaccgacggcggcaccggcggccacattaccggcgacaacgtggttatcgataacgccgggagcactaccgtcagcggcgcagacgccacggcgctgtatatcgaaggcgacaacgcgctcgttatcaacgaaggtaatcaaactatctctggcggcgccgtcggtacgcgcattgacggcgacgacgcccataccaccaataccggtgatatcgcggtggatggcgcgggctctgccgccgtgattatcaacggcgacaacggcagcctgacccaggcgggcgatctgctggtcaccgacggcgcgatgggcatcatcacctatggcaccggaaatgaagcaaaaaataccggcaacgccaccgtacgtgatgcggactcggtgggttttgtggttgcaggcgaaaaaaacaccttcaaaaacaaaggggatattgacgtcagccttaacggcaccggcgcgctggtgagcggcgatatgtcgcaggttacgctggatggcgatattaacgttgtctcagtccaggacagcgaaggcgtgtttagctcagcgacaggggtgagcgtgagcggcgacagcaacgccgttgatatcaccggcaacgtaaatatcagcgccgactacgggcaggatgatctggctgccggggctcccccgttaaccggcgttgtcgtcggcggtaacggcaataccgttacccttaatggcgcgctgaatattgatgacaacgatctgtccgccaccggcggacaatacctggacgttgttggcctgagcgtaacaggtgatgataacgacgttgagattgacggcggtattaatatcacccacagcgaggatccacttgatggaacctctgcagacattaccggcatcagcgtcagcggtaacagtaccgttacgctaaacggtcattctaccattgataccaacacggtagtgggggggcacgttgtactggcgcgggtcaacaacggcggctccctgattctgggtgatgactcagttgttgacgttaatgtcagttatatacccacaggctattacacctacaacgcgttgctgatggctgatggcgaaggcacatcaattgaaaataaaggcgatattacaagccatggcgtgtattccgtcattcgcgcagataacggctcggaagtcagcaacagcggagatattctggtctacgcgaccagtagcaacagtagtgaggatcgtgcagccatcacaagggctagtggcgagggatcggctgttcataacaaagccggcggcgatatcaccctcatttctgatcagacgccgcagggcagtggcggtattgaagtatacccattgaaatggtacacccacaccttttacgccatgatggcttcggattatggcgatgtcgttaacgatgagggcgccacgatccatttgcagggggcaggtgtatatggcgttaccgccagccgaggtaaagcactaaacgaaggcaatatctatctggatggccttgtcccgacgctggacgatgaaaataacatcaccagcaccagctactggcagccatcatcgctctatctcaccagctcaggaatggtggcgggttccaccgatgccgatggcgacgccaccgccatcaacaccggcaacattaccgtcaacaacgccgggttcggcatgatggcgcttaatggcggcaccgccattaaccagggcgtgatcaccctgaccgccgatgacggcgtgaccggtcaggcagacgagctggtcgggatggcggcgctcaacggcggcgtcgtcatcaacgacaccagcggcgtgattaacatcgacgccgattacggccaggcgtttctgagcgacagttccagctacatcatcaataacggctctatcaaccttaacggcagcccgatggatgatactgattcacacatgggcggcacgccaacggacaaaatctggattcagtctctgcccggcagcggcgacagcgacaccaggacctccgacacaggtttcttcaccgccggtacgctggccaactacggtactgaaaccctgaacggcgatgtggacgttaacgggggctggctgtacaacgaagcgggcgcctcgctcaccgtcaacggcaccgtgacgattaacggcggggctaacgcgctggctaactacgggacgctggacgcggacgctatttccacctggcacagcctctttaatgaagcggacggcagcatcaccaccgatctgttaacccttaatggcgacgtcactttttacaataacggcgatttcaccggctccatagcgggcaccagctaccagcaggaaatcgtcaatactggcgatatgacggtggcggaagatggcaaatcgctggtcagcggcagcttctatttctataacgaagaggacgctacgcttaccaacagcggcagcgcggtggaaggcggcgagaacaccatcatcaatctgacgcgcgccaacgattcgctgacccaggtgaacagcggcaccatcaccgccactaacggttacagcgccatcaccacggtcaacggcagcaatgaccccaaatggatctggaacaccgcaaccggcgtgattaacggtattaacccggatgcgccgctaatcaatttgggccgcggctataacttcggcaaccagggcactatcaacgtgcagggcgataacgccgtggcgattagcggcggcaccagcagttatgtcattaacctggtcaatagcggcaccatcaacgtcggtaccgagcagggcaaggaggacggcaccaacggcaccgggcttatcggcatcaagggcaacggtaatgccaccaccataaacaacaccgcagacggcgtgatcaacgtttacgcggatgactcgtatgcgtttggcggcaagaccaaagccatcatcaacaacggcgaaatcaacctgctgtgcgacagcggctgcgacatctacgcgccgggtactacgggcacgcagaacgaccataacgggacagcggacatcgtcatcccggatgcgactaccgccccgaccgagggcagcatcccgacgccgccagcggatcccaacgcgccgcagcagctctccaactatattgttggcaccaacgccgacggtagctccggtacgctgaaagccaataacctggtgattggcgacaacgtgaaggtggataccggctttaccagcggtacggcggataccaccgtggtggtggataacgccttcaccggcagcaatatccagggcgcggacaacatcacttccaccagcgtggtgtggaacgcccagggtagccaggatgccgacggcaacgttgacgtcaccatgaccaaaaacgcctatgccgatgtggcgaccgacagctcggtaagcgacgtggcgcaggcgctggacgccggttacaccaacaacgagctgtacaccagccttaatgtggggactaccgccgagctgaacagcgcactcaagcaggtgagcggtgctcaagccaccacggtattccgtgaagcgcgtgtactcagcaaccgctttaccatgctggccgacgccgcgccgcaaattaaagatggtctggcgttcaacgtggtggcgaaaggcgacccacgtgcggagctgggcaacgacacccagtacgacatgctggcattacgccagacgttggatctcaccgccagccagaatctgacgctggagtacggtattgcgcgtctggatggcgacggttcgaaaactgcgggcgataacggcctgacaggcggctacagccagttctttggcctgaagcacagcatggcgtttgatgaaggtctggcgtggaacaacagcctacgctatgacgtgcataacctcgacagcagccgttctgttgcctatggcgatgtcaacaaaattgccgattccgacatgcgtcagcagtaccttgagtttcgcagtgaaggggcgaaaactttcaccatgatgggcgatgcgctgaaagtcacgccgtatgccggggtgaaattccgtcacaccatggaagatggctacaaagagcgcagcgccggagattttaacctgtcgatgaactctggcaacgaaacggcggtagactctattgtcggcctgaagctggattacgccgggaaagacggctggagcgccaccgctaccctggaaggtggcccgaacctgagctacagcaagagccagcgtacagcgtcattacagggtgcggcgggtcaatcgttcggcgtggatgacggtcaaaaaggcggcggcgttaatggtctggcaaccatcggcgtgaaatacagcagcaatgataccgcgctacatctggatgcctaccagtggaaggaagacggtatcagcgataaaggctttatgcttaacgttaagaaaacatttcgttaaataaacgacattatataacactaataaatatcctccggcatagccggaggtttttcagatgcgcctataaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtgttcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaataaaggccgcttattattaagcggcctttttaaatcatatcccctggtaaagataaagtccttatttggactacctggatgattcattaattgctatcgtactatacgctaaatagatcttatatttattccaccagtagtgctcgttttatcaacaaggattttgaaatgtttaaatttgtaaaaattgccgttgtggcaggggttctggcgacgctcactgcttgtactggtcatatcgaaaacaaaaaaaataactgcagctacgattatttgctgcaccctgcaatttctatttctaaaattattggcggttgcggcccggctgccgatcaataatagaaacgactgcgcagatacaaaaaaaccgggattttcccggtttttttacaggtctgataaacggtacggcacaggtgccttgtccaacttacgctcgttggtaggcccgataagctagcgccatcgggcacgcaataacccttacggtttcgccacaaagccaatggcttcgtaaacggctttcagcgtttcggccgcacgtgcgctggctttttccgccccgtctttcatcaccttctgcaagaacgcttcgtcgttgcggaaacggtgatagcgctcctgcaactcagacaacattccggaaaccgcctccgccacttcgcctttcaaatggccatacattttaccttcaaactgtttttccagttcaggaatgctctgaccggtcacggcggaaagaatatccagcaggttagagacacccgctttctctttcacatcataacgcaccaccggcggctcgtcggagtcagtgaccgcacgtttgattttcttcactaccgatttcggatcttccagcaagccgatcacgttattacggttatcgtccgatttggacattttctttgtcggctccagcagcgacatcacgcgcgcgccggatttgggaataaacggttccggtactttgaaaatatcgccatacagcccgttaaaacgctgggcgatatcgcggctcagttccagatgctgcttctgatcttcgcctaccggcaccagattggtttggtacaacagaatgtctgccgccatcagcaccgggtaatcaaacaggccggcgttaatgttttccgcatagcgcgcagatttatctttaaactgcgtcatacggctcagctcgccgaaataggtatagcagttcagcgcccagccaagctgcgcatgttccggcacatgggactgaacgaaaatagtgctcttttcaggatcaataccacatgccaggtacagcgccagcgtatccagcgtcgctttacgtagctgctgcgcgtcctgacgcacggtaatagcatgttggtctacgatgcagtagatgcaatgatagtcatcctgcatgtttacccactgacgcaatgcccccatatagttgccaatggtcaattcacctgagggctgtgcgccactaaaaacgatgggcttagtcattttttatttcctggttatcgctatgcggaagcccaagtgcgggcaaaagatcgttaaaactgtcataaatgacgtccggctcgctaagagcgatcgcttcgccataattgtagccgtatgtcaggccaaccgaagggcagcccgccgcttttgcagcctgaatatcattacgcgaatcgccgacaaaaagcatctgctccggcatcatgcccagccggcttgccaccagcaacagcggctccggatgcggcttcttattttgcacatcatcgccgccgataaccacactaaagtatttggcgatatcaagcgattccagcaacggcgcgacgaacggcgtcggcttattcgtcaccagacctaatgacaatccgctggcgtgcagcgcgcccagcgtgtcggcgacatggggaaataaaacggtgccctcttccgccacttcgccataatacctgtcgaacagcttacgcagaatacgtacctgttcctcggcaggaatatcttcatcaacgggcggtttacccatcgtcttacgcagcgtggcgcgctcctcgcgagcccaggtcagcgcgcgttccatcaatacgtctgcgccgttaccaatccaggtaatcacgcgctcctcgcccgcgaccggcagttccagcgcatacagcgccatatccaccgccgcggcaagacccggcgcgctatccaccagcgtgccgtcaagatcaaaggcgacgccccgaatattctgcaacttatccatgagttacctttgccagctcactgcgcatttcatcaatcacttttttatagtcgggtttatcgaaaattgccgaccccgcaacaaacatgtccgcacctgctgcggcgatctcgccgatattgttcaccttcacgccgccgtccacttccaggcgaatgtcgtaaccggacgcatcaatgcggcgacgcacttcgcgcagtttatccagcgtctgcggaataaaagactggccgccgaagcctgggttcacggacatcagcaggatcacatccagtttgtccatgacgtaatcgagataactgagcggcgttgccgggttgaataccagccccgctttacagccgtgttctttaatcagctgtagcgtgcggtcaacatgttcggaggcttccgggtgaaaggtaatgatgctcgcgccagcggcggcaaagtcgggcacgatacggtcgactggcttgaccatcaggtggacatcaataggcgcggtaataccgtactgacgcagggatttcagcaccatcgggccgatagtcaggttcggcacatagtgattatccatgacgtcaaagtgtacaacatcagcaccggcagccagcgctttggcggtgtcttcacccaggcgagcaaaatcagccgacagaattgagggggcaatcaaatactgtttcatccgcttctccttgagaattattttcttgcaggcgttgcgactcctggttggtacagagccagcagttcgtccacctttttacgtgtgccgccgttgctgcttatactgcgtctaactttgacgacatgcaattttgcgagttgataccactcgcgtgtgagcgccgtatcatggttggaaatgagcaccggtatccggttactgaccagattctcagcgatttccgccagatgcgcttgttgcgtcaggctaaaactattggtgtgatacgctgtgaagttagccgtggcggacaacggcgcataaggcggatcgcaatagaccaccgacgacttgtccgcacgcgccatactgtctgcgtatgactcacagtaaaagaacgcattctgcgctttttctgcaaagtggtacaactccgcttccgggaagtaaggtcttttataacgaccaaacggtacattaaattccccgcgtaagttatagcgacagagtccgttataaccgtagcggttcagatataaaaacagtaccgcccgacgaaaggggtcctggcaggtgttgaactcctcgcggagttggtaatagacctcagcctggttagtttcaggcataaacagctcgcgcgaagcctgtacatactcgtcagtacgtaacttcacgatgttatagaggctaataaggtcgctgttgatatcggcgaggatataacgagaaaagtcggtgttaagaaacaccgatccggcacccacaaaaggttcgacaaggcactcgccttttggcaaatgtcgtttgatatcatcaagcagagggtattttccccctgcccacttcaaaaaagcgcgattttttttcatgctgactaactaattacaccttctccggctgtggagaaagctccgacagcatcctgcgctttaggctgtgccgcgttgctttacggcgcatttgacggtagcaaatgcgcccctcgcgcctgtcctgaacaaaaatagctgtcagcgacactcacaggcaattgcaggacacagcctggattatttcagatcggcctgaacctgatgcaacggttttgcccacgggtttttcgcctgcacatcggcaggtaaggtggacaccgcacgtttagcatcttctttcgaagcatacatccccgttaccagcacataccacggttgtccattacgcgtcgtctcgtataccacataatttttcaggttctctttcttcgcccaaccgttcaggttgtcgtaatttgaagaactactgagctgcaatgtgtagtggctggatggcgcgctctttaatgcgccaacgttgccggcgcttttcccgccgcctgcgacaggcgtcgtcgaggcttgcgctggcttcgcggtttgtaccggcgcagcgcttgccgtcgctgtcggcgcagccgtcgtggtggtcgctttcggcgtcgcggctggcgctgccggttccgtgcgtttcactggcgcgaccggtttcttcggttccgcagtggtggttttcgccgtggtctgcggtttcttaggttcaatgacggcctgtttacgttccggacgcgtggtatgacgctcggcaggttcgctaaccgccgcctgacgcgtcgtgctgccattgcgaactggcgcgacggttgcaggctctgtcggcaacgtagagttcaccgcaacattgttcatctgctctggattctgcgtcagcgcattattcagatcgccctgcacttccacgcgctgctgaccgtcagcgaccacaggcgactgtccctgcgtcggcgttgaagaaatcggcggcaacgaaatatcctgcgacgtattgcccgcggtttgttctgcggaggtggcgcccggcgcaggctgggtcgcattcgcctgatcggcggcgttaccggaaagatcgatactcttttcgccagaggccgacggctcgctggaagacgttgagggggctttcagcgcggagccgataccgataatcaacagcagcagcaccagcacgccaacgcccatcatcatgtattgacgagaggctggcttatgggccgcttttttacgcttacgtggacggcgttcaacacgctcttcgtccaccgtatcgtcttcatcggattcgtactcttcttcaacttcaggttcttcactacgcgctttacgcgtacgcgtcggacggcgatcgtcggcgtccagatcaacgtcatcaaagttgatctgcggttcactatcgcgttctgaagattgacgagaacgaccagtacgacgatcgctgggatcgggtttcagctcgtcttctggtttgaattcatccatttaacaccccactcaaaggttaatgcttacgacattgcacataacctgaagctaaaaaactgacatctacgcaatatcagtttgacctttcttgttgtcacgcctgctgacagtcagcaatcgcgctaagaacgacttcgtgcgacactccgccgcgcacttcacttttccctatggccagcggaagcactaaacgcagctcccccgctaacacttttttatctcgcagcatgtgcggcaaatagtcctgcgcggacatctcgcaagggccattgactggcaacccggcccgttcgagtagagcgatgatgcgctgcgtatcagcagaactgaactgccctaaacgctcggatgcgcgtgcagccatcactatacctgcggcaacggcttcaccatgtaaccaattgccatatcccatttccgcttcaatggcgtggccaaaggtatgtccaagattcagtaaagcacgtaagcccgcttcacgctcgtcggcggcaacaacttcggctttcagctcgcaacaacgacgaatacagtacgccatcgccgggccgtccagacgcaatagcgcatccagattaccttcaagccaggtgaagaagtccgcgtcgagtataatgccgtatttgatcacctctgccagtcccgatgtcagttcgcgtgcgggaagcgttttcaggcaatcaagatcgacaaccacagaagcgggttggtaaaacgcgccaatcatgtttttgccaaggggatggttgacggcggtcttcccgcccacggaagaatcaacctgcgacagtaaggtagttggcacctggatgaaacgaacgcctcgctggtagctggccgccgcaaaaccggtgagatcgccaatcacgccgccgccaagcgcgaccagcgtggtatcacgaccatgcggttttttcagtaacgccgtaaacaccgtatccagcaccgtcaggctcttatactgctcgccgtcaggaagaatcacgctgtctacgttaacgcccgcccgttcgagtacgccgcgaaccttgtccagataaagcggcgccagggtttcgttggtcactaacatgacctgatcgcctgatttcagcggcaagaatgaagctggttcgttaaacaaaccagccgcgatggtgatcgggtaactacgttccccgagagtgactgtaatcctctccatgacgcgacatccaccttagttacttgtgcccgcttacccagcgtattctgcttgaattagttgctttccagcatatgaataatctggtttgccacaaccttagcgctttgatcgtcggtgcgaatggtgacgtcggcaatctcttcgtacagcggattgcgttcgttagccagcgcttccagaacttcgcgaggcggtgcttcaacctgcaacagcgggcgttttttatcacgctgcgtgcgcgccagttgtttttcgatggtcgtttcaaggtagaccacgacgccacgcgcggagagacggttacgcgtttcacgcgattttacagagccaccgccggttgccagcacaataccctgtttttccgtcaattcgttgataactttttcttcacgattacggaagccgtcttcaccttcaacatcgaagacccagcccacatcagctccggttcgtttctcaatctcttgatcagaatcgtaaaattccatattgagttgttgagctaactggcgcccaatagtgctttttccggcacccataggcccaaccagaaagatattgcgtttctctgccattttttcggtactactaagactattcgttaatggtaaacccgcttcacagacacccagcgcagcaggacatgaactgaaacctcataagatattgcgagagtcagactgaaaattatctcaatactcaagcgggtttggcaactgaataaatcaccaagcctgattgttgcaaaacccgagttagcgttgccgaatggcgaccagaacaacatatccggcctacaaattgctctactttcaaacaattgtgcgcaatccgcagaaccaatacgtctgcatcagcggacattcagccgtttatcatcggtcttatgcacaccttcggcaaggcaaagcgcattaatcaatgcgtaagcaacgaaaagcacgactctcaaatcggtactccttgtatgctaaatacatccgcacgtcaaatcccgcagatgcgttcagtgcaaaaacagcgcttttttatgcataaattattctgtcgccaccagtctgggggtgataaacaccactaattcgcgtcgctcgtcctctttaccgtcatggcggaagagctgaccaagccagggaatatcccccaacagcggcacgctatcgctacccgatttattttttcgcgaaaaaataccgcccagcgccagcgtctcgccgctttttacctctacctgcgtttcaatttcctgtttatctatcgccagcacttcgccgtcagcctgttgtagtacctgaccgggaacattctggctgatatgtaacttcaggcggatgcgccctttttgcaaaacggtgggcgtcacctccattcccagtaccgcttctttaaattccacggaggtcgcgccgctttcgccgctggaaacctgataaggaatttcgctgccttgcttgatactggctggctgtagatgcgaagccagcagccgggggctggcgataatatccaacagctgcttttgttccagcgctgacagctccagatccagcaagcgtccgttaatgcgcccgatgttaaacccgacgcgtgaggtggcggcggcgacagataaatcactggaaagcgtcgtcacgtcacccaccgagcccgcttgcgtcgcgtcagccagcgtccactttacgcccagttcccgtagactcttttcgttaatggtaacgatatgcgccgccagctccacctgcgccaccggcagatccatttgcgatacccatttttccagctccgccaaggccgcgcggttatcgcgcaacagcaggcggttggtgcgcttatctaccatgatggttcccttcgcgctcaggagtttctcgcccgctttcgccagttcgccggcatcggcgtattgcaggctaatgctgcggttttccagcggtaaattagcctgaaaccttaaccgctcggcatcctgccgcgcactgtgttctttctgccaggcctgtgaatgaacatggagaatattcccctcctgacgtagcaccagccccgcgctattgaccaccgtctgtagcgcctgtttccacggcacatccgtcagatgtagcgataatgtcccgctgacgtccggcgacaccaccagattctgccgctcctgctcggctaaagtctgcaaaacctgcaccacagggacgtcatcaaccaccagcgtcactttcgccgcttttcccgcctgcgcggcgggcatcaaggctatcagtattatggctatccatcgcttcattgtccgctccctgacgtagccaccgccactgcggcggcgcacaatttttaccggtcgttaacgttaaggtttccgccgtcaggcggacaatcgtccaaccgttttccagcgtctgcccttcttccactcgtcgccatttttgctgactgtctttaagaatgcctgtccatcgctcgcctttacgcaccgcgccctgataccgccactgcgagagttccgctatccggcagcgatcttccggcgggcggaagggatcgcgcattcctgtcaacatcagcaaacaaaaacagagcaatacactgcggctagccttcattcgccaggcgctccagttgcagcgtcatcaataattccgccccctctttacgcaatgaaaaccgacttacgctcatctcgctttcggccaaccggacaaacagcgacggcaccgcatcccaggacgttttcagcgccatttctcccccctgcgccgatggctgccagtgcagcaaacgcaggggaggcgcctggaaatctaacggcgaaaaaggacgcggattttccactgtgcgcccgaaaagcggttcagccgcgacgctcagacggcgcagatgacgccactgttgccgggcggcctcgcgctgctggcttaaccgcgtttgttgcgtatccaacgttttccagccgggatagcccacagataacgcaaccgtcagcgtcaggcacagcacgcctgcacaccaataaaaaacccgaccacggcgcgacatcccgtaccagatatcaaagagcgcgttcacgggcggcgctcctcgttaactgataatggaactgccagcgcccttgcgcatcctgccgcgtggcgcccgtgcggtttagcggaaaactgacatagtgacgaagtgatgtctcaagcgtgagcagggcgtcaaacgttctcgccagcccttccagctctagcgtctcttgctgataattgaggcttgtcagccatgcctgctctggcaacaggttggcaaggtcagtcaagatagattgccaggcttgcgtcagttcacgctgcgcctgacgttgtaatcgcgcctgttgctgccgctgacgctgctgcaactgcggtatgttcgccgcaagcgccgtcgtgcgtccgttttccgtcgtcagtagcagctcgttaatcctcccctcctgccaaaaaaccaaccgggcgatcgtcgcgaggcttgctatcagcagcagggacgcgccccataccacgcaccacagccgcagacgcgctacgtaatgttggcgccgccaggggagcaaattgacagaatgcgccatcagcgtatctcccccatggctaaacccagcgcaatcgcaaagcgataaccgtccggcggaaccggcggttggcggacggtaacggcgtgccaggggtcgaattcgccttcggcgcataacgaaatatgttccggcacgacggataacgtcgcggcaaggtcatgcagcgtcatcgcctctcgcgccgatttacgtccccacgcatagcgcgtcgcccacagccactggctctcatcgcgccagaccagacattgccgccccgaaggtataaacggcagcaagcgctgtaacgcgcaggcatcgggcgttacagcagcgatgcgcacattgagcgtttgcgccagcgttaacagctctgaaatttctttgctttgcacggcggtaacgttgaacgcagggcttagcgcatcgtcctgaaagtcgaaacgcaataagtccggatccatatccagctcacgcgccatcgtttgtgaaagccatgcgacttgctcacgttcccgcagacgcatcggcggatgtggaaaagcgcgttgcaatgtccgatttgcgggaaaagagagataaatacggtgacgtagcggcagctcgcggctccagggtcgcagtacgtgagccagcgattgcgggtcaggaatcgtaccctctgccgtggaggcgttcatcagcggcagtcgccaccaacgttgcagagaccagcccgatgcgccgtgaataacggcgatggccagcgcttcatgctgctgaatatgcaatcctatttgccaggttttaaaagccataacggtcgatctccttatcacccgtcgcgttaacgggtatatcaatgcgtctggcttgcctttatactaccgcgcgtttgtttataaactgcccaaatgacactaaatgggaaatctccagtgaagttcgtaaagtatttattgatccttgcagtatgttgcatcctgctgggagcaggctcgatttatggcctttatcgctatattgagccacagctacctgacgtcgcgacattgaaagatgtgcgtttgcaaattccgatgcaggtttacagcgcggatggcgaacttatcgcgcaatatggcgaaaaacgtcgtattcccgttacgctcgatcaaattccgccggaaatgatcaacgcctttatcgccaccgaagatagccgcttttatgagcatcacggcattgacccggtaggtattttccgtgcggccagcgtcgcgctcttctccggtcacgcatcgcagggagcaagtaccattacccagcaactggcgcgaaacttcttccttagccccgaacgcacgctgatgcgcaagatcaaggaagcgtttctggcgattcgtattgagcagttgctgaataaaaatgagatcctcgaactctatctgaacaagatctatctcggctaccgcgcctatggcgttggcgcggcggcacaggtctactttggtaagacggtcgaccagcttagtctaagcgaaatggcggttatcgccgggctaccgaaagcgccttctacctttaacccgctctactcgatggatcgggcgatagcgcgccgtaacgtagtgctttcgcgaatgttaagcgagggatatatcactcaggcgcagtacgatcaggcccgtagcgaacctatcgacgcaaattatcacgcgccggaaatcgccttctccgcgccttatctgtcggaaatggtgcgccaggaaatgtataaccgttatggcgaaagcgcttacgaagatggttatcgtatttacacgaccatcacccgcaaagtgcagcaggccgcgcaacaggcggtgcgtaataacgtgctggactatgacatgcgccacggttatcgcggcccggcgaatgtgctatggaaagtgggcgaaacagcgtgggacagtaaaaaaattaccgatacgttgaaagcgttgccgacctacggaccgctgcttcccgccgtggtcaccagcgctaatccgcaagaggcgaccgctgcgcttgccgacggtacgtccgtttcgctacatatggaaggaatgcgttgggcgcggccttaccgctcggatacgcagcaggggccgacgccgcgtaaagttaccgatgtcgtccagacaggtcagcaaatctgggttcgtcaggtggataacgactggtggctggcgcaggtaccggaagtgaactccgcgctggtttcgcttaacccgcaaacaggcgcggtactggcgctggtcggcggtttcgattttaatcagagtaaatttaaccgcgcgacgcaagctttgcgtcaggtggggtcgaacatcaaaccgttcctctacaccgccgcaatggataaagggctgacgctcgccagtatgctcaacgatgtgccgatttcccgctgggacgccggggcaggttcagactggcgtccgaaaaactccccgccgcagtacgccggaccgattcgtttacgccaggggctggggcagtcgaaaaacgtggtgatggtacgcgccatgcgcgccatgggcgtcgactatgcggcggagtatttgcaacgcttcggcttcccggcgcagaatatcgtgcataccgaatcgctggcgctgggctccgcctccttcacgccgatgcaggttgcgcgcggttatgcggtgatggcgaacggcggtttcctgatcgacccgtatttcatcagcaagattgagaacgatcagggcggcgtgatcttcgaagcgaaaccgaaaatcgcctgcccggagtgcgatatcccggtcatttacggcaatacgcagaaatctgacgtgctggaaaacaccaatgtggaagaggtcgcggtttcgcaagagcagcaaaacagcgccgtaccgatgcctgagctggaacaggcaaaccaggcgctggtcgcgcaaaacggcacgcaggaatacgcgccgcatgtgatcaatacgccgctggcgtttctgatcaaaagcgcgctgaacaccaatatctttggcgaacccggctggatgggtaccggctggcgtgcggcgcgcgaccttaaacgtcgcgatatcggcggcaaaaccggtacgaccaacagctcgaaagacgcatggttctccggctatggtcctggcgtcgtcacttccgtatggatcggctttgacgatcaccgccgtgatttaggccgcaccaccgcttccggcgcgatcaaagatcaaatctccggctatgagggcggcgcgaagagcgcgcaacctgcatgggacgcctatatgaaagccgtgctggaaggcgtgccggaacagccgctaacgccgccgccgggcatcgtcacggtgaatatcgaccgcagtaccggacaactggcgagcggcggtaacagccgtgaagagtatttcatcgaaggcacgcagccgacacaacaggcggtacacgaggtgggaaccaccattattgataatggtgaaacacacgaactgttctgatcaaaaaaggcgctccggcgccttttttattgtgtttagcggatgacggcgaacggggagacaaactttccgttggcttgatcaacgccgcgccatcaggcaattcggccctgcgctttcaaccactcgcgtaccagaaacagcgcgctgacgttgcgggcctcgttaaaatcggggtcttccagcagatccattaaatgcgccagcggccagcgtacctgcggcaatggctcaggctcgtcgccttccagcgactccggatagagatcttccgccaccacgatattcattttgctggaaaaataagagggcgccatgctgagtttttttaagaaggtcaggttatgcgcgccaaacccgacctcttctttgagctcccggttcgccgcttcaaaaacggtctcgcccgggtcgatcaatcctttcgagaagcccagctcataggattcggttcccaccgcatactcacgaataagaatcagatgctcatcaacgatcggcacaatcattaccgcctcacgggttgatggtcgcatacgttcatacacgcgacgcacgccgttgctgaactccagatccacgctttctacgttaaacagtcgggattgtgcgacggtttccactttcagaatggtgggtttttgtaatgatttgctcattgtgagaatctttgcagtgtaatctgtggtcattgtgcgacataccgcacggtttcggcaatgcgaattgccgtttatttacatttatgtaacgtaataaaaattaattcttatttcaaattaaaagtcaataggttgaaataactccaggaatttgctgatattccgtttttggtggtattgctatgatttgccttcactgggatgcgctttacaatgctcaagttcaactccacgcttgccgatagccaaccacagaaaaatgtttattggacagggtgcgactgaccacgcctgacagacttagtaagatggggaaagcatgagcaccattctgatttttatagctgctttgctggcctgctctctactggcaatatggcggttccgggtaaagtccagacgagggagcttaccgtggatcagcgcctttcaggacgcgcaaacgcgtaaactgttgcccgaagagcgcagcgcggtagaaaactatctcgataaccttagccagatccagcaagttccggggccgacaggcgccagtgctgcgcccatctcgctgacgctgaacgcggaaagcaacagtgtcgtgatactaacccactccatcacccgctacggcattaccactgacgatcctaataaatggcgctactacctcgactccgtcgaagtccatctgccgcctttctgggaacagtacatcaatgatgaaaacaacgttgagctgatcctcacggatacgctgccgctggtgatctctttaaacggccatacgctgcaagagtatatgcaagagtcgcgcggctacgcgctacagaataccgcctctacgcaggcgtcgattcgcggcgaagagagcgagcagattgagctgttgaatatccgtcaggagacccacgaagaatatgcgctcagccgcccggctggcttgcgcgaagcgttgttaatcgtcgcctcctttttgttattctttttctgcctgataacgccagacgtttttgtaccgtggatgataggcggcgcgatcctgctgctggcagccggactttgggggctttttgcgccgccgtcgaaaagcgcgctgcgggaaattcactgtctgcggggaacgccccgccgctggggactgtttggggagaataatcaggagcagattaacaatatttcgctgggcatcatcgaccttatttaccctgcccactggcaaccctacattacgcaggatcttgggcaacaaacggatattgatatttaccttgatcgccatgtcgcgcgccagggccggtttttatccctgcatgatgaagtgaaaaacttcccgttgcagcactggttacgcagcactgttattgctatcggttcgctgctggtgttgtttatgctgctgttctggatcccgctggatatgccaatcaagttcacgctatcgtggatgaaaggcgcgcaaaccattgaagcgacaacggtaaaacagcttgaaaaagctggcgtgcgggtgggcgatacgctgcacctgagcggtaaaggaatgtgtaatattcattccggcgcgacctggagcggccagtctaactcaccgtttatgccgttcgattgctcgcaaatcatctggaatgacgcgcctgcgctaccgctgccggaatcagacctggtgaataaagcgatggcgctaagccaggcggtaaatcgtcagctccatccaaaacccgaagacgactcgcgcgtaagcgcatctttacgctccgcgatccaaaaatcgggcatggtattattagatgactttggcgatattgttctgaaaaccgctgatttgtgcgcggcggaagacgagtgcgtgcgtctgaaaaatgcgctggttaatctcggtaacagtaaggactggaacgcgctggtgaaacgcgcgaacgccggcaaactggacggcgtcaacgtgctgctacgccccgtaagcgcagagtcgctggaaaatctggtcacgacctcaacggcgccgtttatttctcgcgagaccgcgcgtgccgcccagtcgctgaatagccccgctcccggcggattcctgatcgccagcgatgaaggcagcgaactggttgatcagacctggccgtcaacgccgctgtatgactatcccgcgcaggaacagtggagcgccttccagcgtctggcgcaaacgctcatgcagacgccatttagcgccgagggcattgtcaccagcgtgtataccgatgccaacggcacgcagcatatcagcctgcatcgtatccccgataaatccggctggtggcgttacctcggcaccacgctgctgatgctggcaatgatagtgagcgcggtctacaacggcattcaggcgttcaggcgttatcaacgccaccgtacccgtatggcggacatccaggaatactatgaaagctgcctcaatcccaggttaaccgtctctccggaaaatctcatctgatagcgccgccgtgcgacagggtatgctaccctgtcgcgcaaattgcgttaccctggagttccccatgcatattgatattgactggcaaaacgtggataccgttttgctggatatggacggcacgctgctcgatctcgcgttcgataactatttctggcaaaagctggtaccggaaacctacggcgcgcagcagggtatttcgccgcaggacgcgcaggaatatattcgccagcagtatcatgccgtacagcatacgctaaactggtactgtctggattactggagcgagcgtctgggtctggatatttgcgccatgacgacggcgcaagggccgcgcgccgttttgcgcgacgataccgtaccgtttctgaatgcgttaaaagccagcggaaaacgtcggattctgctcaccaatgcgcatccacataacctggcggtgaagctggagcataccggtctggcctcacaccttgatttattactttccacccacacatttggttatcccaaagaggatcagcggttatggcgcgctgtcactgaggaaacgggaataagcgcagagaaaacgctgtttatcgatgacagcgaaccgattctcgacgccgccgcccggtttggtattcgctactgtcttggcgtgacgaatcctgattccggcctggcggaaaagcactatacgcgccatccgtccctgaacgactaccgccgtctgatcccctcgctgatgtgaaggagacgccatgaaagaaaagtcctccgttgaggtcagactggataaatggctgtgggccgcgcgtttttataaaacccgcgcgatggcccgcgagatgattgaaggcggtaaggtgcattacaacggccagcgcagtaagccgagcaaaatcgtcgagctgaacgcaacccttaccctgcgtcagggaaatgacgaacggacggtgatcgttaaagccatcaccgaacagcgccgtccggccagcgaagccgtcgctctgtatgaagagacggcggaaagcgtggaaaaacgcgaaaaaatggcgcaggcgcgcaagcttaacgccctgaccatgccgcatccggacaggcgaccggacaagaaagagcgccgcgacctgttacgatttaaacacggcgacagcgaataactgtcacccgcaagagagatgattatgccgcaacatgaccaattacatcgttatctgtttgaaaactttgccgttcgcggcgagctggtaaccgtttcggaaaccttgcaacagatcctcgacaatcataactatccgcagccggtgaaaaccgtactggccgaactgctggtcgccactagcctactgaccgcgacgctgaagtttgctggtgacattacggtacagctccagggcgacgggccgttaagcctggcggtgatcaatggcaataatcagcagcagatgcgcggcgtagctcgcgttcagggcgatatccctgacaatgcggatctcaaaacgctggttggcaacggctatctggtgatcaccattacgccggaagagggtgaacgctatcagggcgtggtgggtctggaaggcgatactctggcggcgtgcctggaagattacttcctgcgctccgagcagttgccgacgcgcctgtttatccgtaccggcgatgtcgacggtaaaccggcggcaggtggaatgttgcttcaggtgatgccggcacagaacgcgcaggcggaggatttcgaccatctggctatgttgacggaaaccattaaaagcgaagagctgctgacgttaccggcaaatgacgtgctgtggcgtttgtatcacgaagaagaagtcacgctctacgatccgcaaaatgttgaattcaaatgcacctgttcacgcgaacgttgcgcgggcgcgctgaaaacattgccggatgaagaagtggacagcattctggcggaagaaggcgaaatcgatatgcactgcgattactgcggcaatcattacctgttcaatgcgatggatatcgcggagatccgtaacaacgcctctcctgccgatccacaggttcattaatcgcctttcagtcgacaacatcattgcctgatggcgctcgcttatctggcctacagcatcccgctccgtaggccggataaggcatttatgccgccatccggcaaaaagcttactcgttgtagtaatccacatccaaccgctgaccatcaacaatgatatcgcgccaggctttgggggctgagtctaaccgatgcccggcaatcgcgtgcaacagttgcgtcttagaaaacccgtccggcagtcgggcgaacgctttctgcgtccatttcccctcttttaagccgtagacctggctctcggcaacaataaagttatacagcacctgctcaggctgaccgtcgccgttaagatcctgactcaccagcacgcaggcatccggttcaaggcaggaatcgtccgaataactctgctctttgacaaacgcccaaaatgcggcatccggcttctggctaccgggcgcaatcatcaccacccgcgctaaatcgtccgccgtcggagagaccttatttctctgcaaaaacgtcatcagttcacgattgcgctttctgttctgcgtaaacgcctcgtcatcccgcaacgatttcagcgcttcctggccaggtttgccgctgtgatccagcatatacaggctgatctgatccgcagtaattttaccactatggtaacgcgccatatggctgttgacgctaatacgccagacatcaagtacaggcgaggccagcaacagcaatatcaccagcgtcaacaaagagacgctcagtatcaccttgccttgccactcaccagggtcgcgtccgcggcgtaacagaccgatcagataaccgaaggaccataccagcaagacagacaccgtcagcgcaccatacagacgatccggcgtccaaccgtattgctgaatgcgtacccataacgcccagcccgccagcagcatatatatcggggcaacgcacagcgaggcgctaatcatgccgcgtagtacgcgcggatagggtaatacgcgcttttgcggttcgttgacaatcgccacgaggagcagcagcatcagcgtcagcgtggatagcagccccgcagcggaaacacgcgcagaaatcgcctccagtccggtaaagggtaacgtcacaataaacagcaatgccagcagcgacaccactggcagtaaacccgtcgcgatcagcgtcagcagcttttgcaccgccgccacaaggcgcgactgcgtgcgggcgagaatgaccgccagcgccgtaatcaggccgatggtcacataaataaaggcttcagtttcaaagaaaagggtgctgaaaaagcggatgcccaccagcctgaatagcgcgctccagagcagaagcaccagccagaacagtccgttagcgaccaggacgataaacaatgtcagtacgttatgccataaccgcagataaaactggggataacgcgccgaaccggtttgcgaatgtaactgatattgcatccagggtaagaccagcatcgccatcaacacaagccggagaccatacagccagaggagctcggccaggcgccatttctccaccgtctcaacctgccatttcagccagccgctcattgccagcacgaccacaaagatcagccccagccagccccacagcgcgcgctgtttaaaagagaccacggtaagcaatagcattgacgacaacgctatcgtcgcaggcataccatagaacagccagtcgctattttgtggtaccagccaggccatcagcaggtagcacaagacgccctgcagcaaaccggtgagcaacatcccccagcgagtagtatgtgaaagcgctacactttccatgtcgttatccagaatgatgagaaagccgcattattgcaccatctgttcaccgccaggcgtcgtcatgcataattcagaaaaaaacgcagagaggtgaatcgatattgttaatgttggtgttacgtaactttcttacatgaatgcgattacagtcacattatgtcggtcaaaaacacttccttttaacgttttcagaacattttccacaacaaaagtaggtttcctgccataataaccgccgctgcgtgacaggagtcacagtgtttttcgtcaatcgtgattttgtccagatacgtaaatctatgagccttgtcgcggttaaccaacctcaaaaaaccttactattttcggtaatatatattggctaaggagcagtgatatgcgcgttaacaatttaaccccgcaagatctcaaggcttatggtatcaacgacgtccaggatatcgtttacaatcccagctacgacaccctttatcaggaagaacttaatcctggtctggaaggctatgagcgtggcgtgttaactaacctgggcgctgttgccgttgataccggtatttttaccggtcgttcgcctaaggataagtatattgttcgcgacgacaccacgcgtgatacgctgtggtggtccgataagggtaaaggtaaaaacgataataagccgctttcccaggaaacctggcaacacctgaaaggtctggtgacgcatcagctttctggtaaacgcttattcattgttgatgcgttctgcggcgcaaatgccgatacgcgtctttccgtgcgctttattacggaagtcgcctggcaggcccacttcgttaaaaatatgttcattcgcccaacggacgaagagctggtaggcttcaaacctgactttattgtcatgaacggcgcgaagtgcaccaacccgcagtggaaagagcaagggctgaactcggaaaacttcgtggcgttcaacctgactgaacgtattcagcttattggcggcacctggtacggcggcgaaatgaaaaaagggatgttctcggtaatgaactacctgctgccgctcaaaggtatcgcctcaatgcactgttccgccaacgtgggtgaaaaaggcgatgtcgcggtcttcttcggcctttccggtaccggaaaaaccactctctccaccgacccgaaacgtcgtctgattggcgatgatgagcacggttgggatgacgacggcgtgttcaattttgaaggcggctgctacgccaaaaccatcaaactgtcgaaagaagcggagccagaaatttatcatgcgattcgccgtgatgcgctgctggaaaacgtcaccgtgcgcgaagacggcaccgttgatttcgacgatggttccaaaaccgaaaacacccgcgtctcttacccgatctatcatatcgataacatcgttaagcccgtgtccaaagcaggtcacgccaccaaggttatcttcctgacggcggacgccttcggcgtgttgccgccggtttcccgtttaaccgctaaccagacgcagtaccacttcctgtcaggtttcaccgctaaactggccggcaccgaacgcggcgtcaccgaaccgacccccaccttctccgcctgcttcggcgccgcgttcctgacgctgcacccaacgcagtatgctgaggtgctggtgaaacgtatgcaggcagcaggcgcgcaggcttatctggttaacaccggctggaatggcaccggcaaacgtatctccatcaaagatacgcgcgcaattatcgacgccattctgaacggttctcttgataacgcggaaaccttccgtctgccgctgttcgatctggcgatcccgactgaactgccaggcgtggatacccacattctcgacccgcgtaacacctacgcgtcgccggaacaatggcaggaaaaagccaccgcgctggcgaaactgttcattgagaacttcgagaagtatacggataccccggcaggcgaagcgctggttagcgccggaccgaagctgtaaggaacaggccggatggcggctttgaacggcgtcatccggcgttgagaagaaagggagggtaatacctccctttcttatgcctcttttgtcgtcccctggacgcgagccacaggaaccggtagccaggcgcgaatcgacaatccgccacgctcgctggtgccaatctccagcatcccgttatggttatcgataatgcgctgcacaatcgccagccccagccctgtgccgctggtgctacgggcgctgtcgccacgcacaaaaggctggaacagatgtttacgctgctccggcttaatgcccggcccgtcatcttctacctgaaaccaggcgcgatgcgactcggtgccgctgctgaccttaatccagccgttgccatagcgggcagcattgaccaccatattcgccaccgcgcgcttaatcgagagcgggtgcattttcacctggatgctgcctgcctgaagcgcagtgttaatctcacgctcatagccgctttccgccgcaatcacctcgcccagcacggaattgagatccgccatctccattggcatttcctgaccggtacgcagatagtcaataaactgttcgataatggcgttacactcttcgatgtctttattgatcgactccgcgagataaccgtcttcctcgcccatcatctccgtcgccagacgaatacgggtcaacggcgtgcgcaagtcgtggctgacgcccgccatcaatagcgtacggtcatcggccaattgcttcacgccggctgccatatggttaaacgcccgggtcacagagcgcacttcagaggcgccatattcacgcagcggcggcggaataattcccttccctacctgcaaggcggcatgttcaagatccactaacggtcgattctgtatacgaataaacagccacgcgccgcctatcgccaggagcatgatcgccagcgtgtaacggaaaagcggagaaaaatcgccctgatgaatctcggtcagcggcacgcgcacccagatattgggcgacagccaggttttgagccacacgacgggcgagcttttgttgacctcaacgcgcacttccgtcgggccgcctaattgctgcgccatctggtggcttaagaattcgtagtgttgcgcccaacgcaacccggcctcttcggcggcttcgttggtgtagagagagatccccagctcgcgatagatttcccggcgaaacgcaggcggcacgactaactgcgtgccgtcctccagttgcagcttatcggtcatcagcatacggacttcgtaagccagaaccttattaaactgctggaggctcggcaaaatcgcgaagttcagcaccaccaggtaggtcgtcaccaggctgacgaacagcaaggtgacgatgagcaacagcgtgcgggcaaatgaacttcgcggtgagaagcgcattcgcctcatgctttagaaccgtccggtacaaagacgtagcccaggccccagacggtctgaatataacgcggatgtgccggatcttcttccaccatacggcgcaggcgggagatctggacgtcgatggagcgttccatcgcggaatactcgcggccacgggccagattcatcagcttatcgcgagagagcggctcgcgcggatggctgactaacgctttcagtaccgcaaactccccgctggtcagcggcatcggttcatcttcacggaacatctcgcgcgtaccgaggttcagtttaaacttaccgaacgcgataacggcctcttcctgcgacggcgcgccgggcagttcgtttgcctgacgacgtaacacggcgcgaatacgcgccaacagctcgcgcgggttaaacggtttaggaatgtagtcatcggcgccgatttccagcccgacgatacggtcaacctcttcacccttcgccgtgaccataatgatcggcattggattactttgactacgcaggcgacgacaaatcgacagaccatcttcacctggcagcattaaatccagtaccatgagatggaaagattcacgggtcagcagacgatccatctgctcagcgttagcgacgcttcgaacctggaagccctgctcggtcagataacgttccagtagcgcccgcagacgcatatcgtcatcaaccaccagaatcttataattctcttgcattgtctgtactcccaaaggttcgcaacaaatgtaagtgtgtattcttaaaaaagctcacgtgagtcaccagcaaattctggtatgaatttcaggctaaattgttacaaagcatatttaacagcagcttaaatatacaattaatcggcaaccccattatttattctgtcgggacgatcacgttataccccgtgtgcgcaatatcgacagcaaaggtaaatcaacgagatgaaaacgcccctgatcacccgcgaagggtacgaaacactcaaacaagagctcaattatctctggcgtgaagagcgcccggaggtcaccaaaaaagtgacctgggctgcgagtctgggcgaccgcagcgagaatgccgactatcagtataataaaaagcgcctgcgtgagatcgacagacgcgtcagatatctgaccaaatgcatggaaaatctcaaaatcgtggattattccccgcagcaggagggcaaagtcttcttcggcgcctgggtggaaattgaaaatgatgacggcgataggctgaagttccgcattgtcggctacgatgaaattttcggacgtaaggattacatctctatcgactcgccgatggcgcgggcgctactgaaaaaagaagtgggcgatctggcggtggtcaacacccctgtcggcgaagcaaactggtacgtcaatgcgatcgaatacgtcaaataagacaagaagaatcctaagcccccgctgatggctggcatttttgccagccaatccgtataactatcccctgatttttatcctgaagacgaagctaacccatgatgaatgattctttctgccgcattattgcgggtgaaatccaggcaaatgccggacaggttgaagctgccgttcgcctgcttgacgaagggaacaccgtgccgtttatcgcacgttatcgtaaagaaatcaccggcggtctggatgacacgcagttgcgtaacctggaaacgcgtctgggctatctgcgtgagctggaagacaggcgtcaggccatcctcaagtccatttccgaacaaggcaaactgaccgatgagctggctggcgccatcaacgctacgttaagtaagaccgagctcgaagacctctacctgccctataaacctaaacgccgcacccgtggacaaatcgccattgaagccggccttgagccgctggccgatctgctctggaacgagccgtcccacgatcctgacgtggaagcggcaaagtacattgatggcgacaaaggcgtggcggacacgaaagccgcgctcgacggcgcacgctacattctgatggagcgctttgccgaagacgccgcattgctggcgaaagtacgtgattacctgtggaagaacgcccatctggtcgccaccgtcgtgagcggcaaagaggaagaaggggcaaaattccgcgactatttcgaccatcatgagcccattgctaacgtcccgtctcaccgtgcgctggccatgttccgtggtcgtaacgaaggcattctgcaactttcgctcaatgccgacccacagtttgatgagccgccgaaagagagctactgcgagcaaatcatcatggaccatctcggcctgcggctaaataacgccccggcggatagctggcgcaaaggcgtagtgagctggacgtggcgtatcaaagtcttaatgcacctcgaaaccgaactgatgggcaccgtgcgcgaacgtgcggaagacgaagcgattaacgtgtttgcgcgtaacctgcacgacctgctgatggcagcccccgcaggcctgcgcgccacgatgggccttgatcctggcctgcgtaccggcgtaaaagtcgctgtcgttgacggcaccggcaagctggtggcgacggataccatttatccgcataccggtcaggcggccaaagcggctaccgtgatcgccgcgctgtgcgaaaaataccacgtcgaactggtcgcgattggcaacggtacggcctcgcgtgaaaccgaacgcttctatctcgacgtacaaaaacagttcccgaacgtgacggcgcagaaagtgatcgtcagcgaagcgggggcgtccgtgtattccgcttctgagctggcggcgcaggagtttccggatctcgacgtctccctgcgcggcgcggtctctatcgcgcgtcgtctacaggatccgctggcggaactggtgaaaatcgatccgaaatccatcggcgtcggccaatatcaacacgatgtcagccagacccagttggcccgtaaactggatgcggtggtcgaagactgcgtaaacgccgtcggcgtcgatttgaataccgcctccgtgccgctgctgacccgcgtcgcgggcttaacgcgcatgatggcgcaaaacatcgtcgcctggcgcgatgagaacggtcagttccagaaccgccagcaactgttgaaggtgagccgtctggggccgaaagcgtttgagcagtgcgcgggcttcctgcgtattaaccacggcgataacccgctggatgcgtccaccgtccacccggaagcctatccggttgtcgaacgcattctggcggcgacgcagcaagcgctaaaagatctgatgggcaacagcaacgaattgcgccacctcaaggccgctgattttaccgacgataaattcggcgtgccgaccgtgagcgatatcatcaaagagctggaaaaaccgggccgcgacccgcgtcctgaatttaaaaccgcgcaattcgccgatggcgttgaaaccatgaacgacctgctaccggggatgattctggaaggggcggtcactaacgtcaccaatttcggcgcgtttgtcgatatcggcgttcatcaggatggcctggtccacatctcttccctgtcgactaagttcgtcgacgatccacacaccgtggtaaaagctggcgacatcgtgaaggtgaaagtgctggaagtggatctgcaacgtaagcgtattgcgctgacgatgcgtctggacgaacagcccggcgaaaccgccgctcgccgcggcggcggcgccgatcgcgctcagggcaaccgcccggcatcaaaagcggcgaaaccgcgcggtcgtgacgcccagccagccggtaacagcgccatgatggacgcgctggcagccgcaatgggaaaaaaacgctaatcgggtaatacgcaggccgggttacttcttatccggcctgcgattttgcaatacgtccaaccctttcttttttaattaacaattaaatcttacccattagaatctgttaattaatttccttctgctatccgcactattaattatcactttattaacagatgaaaccttaattaaacattaaaaacggtgaatatttgcacattagaggtatttgcaaaaagacaaataaatgttgagccatatcaacatcggcgcaaattatcgcttatttgtacattccgtcacattttaatcgttgaagatagaaaccattctcattatcattgtgttgttgattatttactctttccttcgttggctaaacatcgggtctcctgccgcccccctgagcgccgcatgaggtatacatccagttagtaagaaacaagtaggtcgtatgcaattcactcctgacactgcgtggaaaatcaccggctttgcgcgtgaaatcagcccggcgtatcgtcaaaaactgctttcgctcggcatgttgcccggctcttcatttaatgtcgtccgcgtcgcgcccttaggcgatccgatccatatcgaaacacgacgcgtgagtctggttttgcgtaaaaaggatttggcgttaatagaagtggaagcggtttcctgttaatacagtgagtctataaaaatgaaaaaattaaccattggtttaattggtaatcctaattccggcaagaccaccttatttaaccaactcaccggcgcgcgtcagcgcgtggggaactgggcgggcgtcaccgtcgagcgtaaagagggccagttcgcgacaactgaccaccaggtcacgctggtagatttacccggcacctattctctgacgaccatctcgtcacaaacctctctcgacgaacagatcgcctgccactacatcctgagcggcgacgccgacctgttgataaacgttgtggacgcctccaatctggagcgcaacctctatttgacgctgcaactgctggagctgggtattccctgtattgtcgcgctcaacatgctggatatcgccgaaaaacagcaggttcgtattgatgtcgacgctctgtccacgcgtctgggttgccctgtcgtaccgctggtatcgactcgcggtcgcggtatcgaggcgctgaaactggccattgatcgtcacaacgctaacgacaacgtcgaactggtgcattatgctcagccgctgctgcgcgaagcggatttcctggccgacgcgatggcccaggagatgcctttacaacagcgccgctggctgggtctgcaaatgctggagggcgatatctacagccgggcttacgcaggcgaggcggcgcaaaacctggatacctccctggcccgtctgaaggacgaaatggacgacccggcgctgcatatcgccgacgcccgttaccagtgtatcgccgctatttgcgacgtggtcagcaataccctgacagccgaacccagccgcttcaccagggcggtcgataaaattatcctgaaccgcttcctcggcttaccgatttttttgttcgtgatgtacctgatgttcctgctcgccattaacatcggcggcgcgttgcaacccctgtttgatgccggttccgtcgccatctttattcatggcattcaatggattggctacacgctgcacttcccggattggttaaccatcttcctggcgcaaggtcttggcggcgggatcaataccgtcctgccgctggtgccgcaaatcgggatgatgtacctgttcctctccttccttgaagactccggttatatggcgcgcgcggccttcgtcatggatcgcctgatgcaggcgctgggactaccgggtaaatccttcgtgccgctgattgtcggcttcggctgtaatgtaccttccgtgatgggcgcccgcacgcttgacgctccgcgcgaacgcctgatgaccatcatgatggcgccgtttatgtcctgtggcgcgcgcctggcgattttcgccgtctttgccgccgccttcttcgggcaaaacggcgcgctggcggtcttctcgctgtacgtgctgggtattgtcatggcggtattaaccggcctgatgctgaagcataccattatgcgcggcgaagcttctccgtttgtgatggagctgccggtttaccacgtcccgcatatcaagagcctgatcatccagacctggcaacgcctgaaaggttttgtactacgcgccggtaaagtcattatcatcgtgagtattttcctgagcgcgtttaacagtttctcgctgagcggcaaaatcgtcgataacattaatgactccgccctcgcctctgtaagccgggtcatcacgccagtctttaaaccgatcggcgtccatgaggataactggcaagcgaccgtgggtctgtttacgggcgccatggcgaaagaagttgtcgtcggtacgctgaacacgctctacaccgccgaaaatattcaggacgaagcgtttaatcctgccgactttcacctcggcgatgaactgctgggcgcggttgacgatacctggcaaagcctgaaagacacctttagcctgagcgtactggctaatccgatcgaagcaagtaaaggcgacggcgaaatggcgaccggcgcgatgggcgtgatggatcaaaaattcggcagcgccgcggcggcgtacagttacctgattttcgtcctgctttacgtaccgtgtatctcggtaatgggcgctatcgcccgcgagtccagccgcggctggatgggcttctccatcctgtgggggctgaatatcgcctattcgctcgccacgctgttctaccaggttaccagcttcagtcaacacccgacatacagcctgatctgtattctggcagtgatcgtctttaacgttgtggtgttaagcctgttacgccgcgcccgcagccgtgtagacattgaactgctggcaacccgcaaaaacgtcagttcctgttgttcgggcactgcgggcaattgtcactaagggatgtaaaaaatggcttcattgatacaggttcgcgatctactggcgctgcgggggcgtatggaggcaacgcaaatcagccatacgctgcacgctccgcagcccatgatcgacgccatgctgaatcaactggagatcatgggtaaagcggtacgtatcccggaagaaccggacggctgcctttcaggcagctgtaaaagttgtccggaaggtaaagcctgcctgcgcgaatggtgggccttgcgttaaccttcgtcgggtagcgacgtaacgcgtcttatccggcctttatcccgcgttatgttgcccggtacgcgtcacgctgccgggcaattttgcgtcatgccttccacaaagatgaaagcgttaccgccgtgcgcatttatctccccacgcgcctcgcaagcgcactaatcctctactgcaatcagcccggtctgcgcgtagtgtcacgccattgaacttcaccgatgacggatcgatatggcgacctcaacaacatccacgccgcatgacgcggtattcaaacagtttttatgccaccccgatactgcacgggattttttggaaatccatctcccgtcgacattacgtcaaatctgtaatctgaatacgttacggctggagtccggtagctttattgaagaggatttacgcccccattattccgatattctttggtcgctggaaacaagtgaaggtgaaggttacatttacgtggttattgaacatcagagtacgccggacgcgcatatggcatttcggctgatgcgttacgcaatggctgcaatgcaacggcacctggaggccgggcataagacgttgccgttagtggtgccaatgctgttttatcacggaaaccgcagcccgtatccgttctcattatgctggctggatgaatttgccgacccggtgatggcgcgtaagctatacgccaccgcctttcctctggtcgatattacggtcgtgccggacgacgagattatgcgacaccgacgggtcgcgctgctggaactcatacaaaaacacatccgccagcgtgatctgatggggcttgtcgaacagctggtcgccctgctggttaagggatacgctaatgacacccagcttcaaagtttgtttaattacatgatgcacactggcgacgccgcgcgcttcaatacgtttatccgccaggtggctatgcgtatcccacagcataaggagaagatcatgactatcgcagacagattacgtcaggaaggacatcgtaacgggttacagcaaggcaagcaggaaggccaacggctcgccgcattgcgcattgcccgctccatgctaaacgatggtttcgatcgcgataccgtgcttagggttaccgggctggcgcctgccgatctggcgtctgaaaaccattaatctggcagaatggtccgggcccggcaacgccctggttacagcgatgattttagcgtcatcagcgcctgacaaaacgccgccggatgcgagataaacggcgcatgggccgccttcgccattatctgtgatgtactgtgcggccataacgtatcgagcaaaggcacgattttacgcggcaccagaccgtccagataaccatacaaacgcaaaaacggcatgttcacatttttaagcgcttctcgtagatcgaccgtttttaagatttccagtccgccattgagcacctctacatccggcataggctgcgccagcaccacgctttttaaggtgcgggcatcctgacgcgccgtctccgtccctaacgtttgcagcgccagaaaacgctccaccgtgcgctgaaaatcgtcgctaagctgctgctggaatccgccgaggatttctggttttattcccggccacccctcacgcgcgctaaagcatggcgaagaggcgacagtcaccagcgcctggacgcgttcagggtgggtgagcgccatctgactcgccaccaggccacccaggctccagccaagccagatagcctggtccggcgcgtttttcgctacctgcgccgtcatctcttcaagcgtcatggcgccaaaccccgagctgcgaccatagcccggcaagtcgaccagatgcagcgtaaaatgcgagccgagttcctcgcgaatgcaatgccatacctccgcgttcaatccccatccgtgcagcagcacaagatgacaatttccctcgccgtaggtctgccaccagatgtcattcatcagttactgttctcttttgtctaacaaggatgcacctatgctaacagtaccgggattatgctggctatgccgaatgccgttggcgttaagccactgggggatttgttccgtatgcgcgcgcgctgttcgtcagcgcgtcagcctgtgtccgcaatgcggattacctgccgcgcatccttcgctcccctgcggtcgctgcctgcaaaaacctccgccctggcagcgtctggtgagcgtcagtgactatacaccgcccttgagtttactggtgcatcagcttaaatttacccgccgcagcgaaattgccgccgcactggcgcgtctactgttgcaggaagtcctcatggcgcgccgcagcactggcttgcagcttcccgacagaatcgtcagcgttccgctctggtcgcgccgacactggcggcggggatttaaccaaagcgatctgttatgccaaccgttagcgcactggctgggctgcgcgtgggacagccagaccatcacgcgggtacgggcgaccgcaacacaacatcatctcagcgccaggttacgtaagcgcaatttgaaaaacgcgtttcgccttgaattgccggtacagggtctccatatggttattgtggatgatgtcgtcactaccggaagtaccgtcgcggaaatcgcgcaactgcttttgcgcaacggcgcagcgactgtccaggtatggtgcctgtgtcgaaccttgtagagcctcgatgatgggcgtattataaccaactaaaatagtcaactattaggccattactatgatccgtatttccgatgctgcacaagcgcactttgccaaactgctggcaaatcaggaagaagggacgcaaatccgcgtatttgtcattaatcccggcactcctaacgcagagtgcggcgtttcttattgtccgcccgacgccgtagaagccaccgatactgcactgaaatttgacctgttgaccgcttatgtcgacgagctgagcgcgccctatctggaagacgcggaaattgatttcgtgaccgaccagctaggttctcaactcacattgaaagcgccaaacgcgaagatgcgcaaagtggccgatgacgcgccgctgatggagcgcgtggaatatgctctgcaatcgcagattaacccgcagttggcgggccacggcggtcgcgtctcgctgatggaaattaccgatgaaggctatgcaattctgcagtttggcggcggttgtaacggttgctcgatggttgacgtcacgctgaaagaagggatcgagaaacagttgctgaatgaattcccggaactgaaaggggttcgcgatctgaccgaacaccagcgcggcgagcactcatactactaagattttccccgcatccatgcccgatggcgcttgcgcctgtcgggccttgtcagccccaccgtaggccgaataaggcgtctacgccgccatccggcgctatcaaccacatctcataacaatggcccttcttctttcgccgataacatgacctgtgtctcataatttaaattttgcctgccagggtcattttcaacacccatatgttacccgtatcattcttatgggcacctaacatccatataacatctgactacgctcattcgtttcaacggtaatcagtattggtgctattgcgactctgttcccgtcgggaacaacaggaatttgtcgtcgaaacaatgacgttacccataacaaagtaaaggccaggtaaatcatgccattagtcatcgttgctatcggtgttatcttgttacttcttctgatgatccgcttcaaaatgaacggatttatcgcccttgtcctggtagcgctcgctgtcgggttgatgcagggaatgcctctggataaagtcatcggctccatcaaagccggtgtcggtggtacgcttggcagtctggccctgattatggggttcggcgccatgctgggcaaaatgcttgccgactgcggcggcgctcaacgtatcgccactaccctgatcgcgaaatttggtaaaaagcatattcagtgggccgtagtgttaaccggctttaccgtcggcttcgctctgttctatgaagtgggcttcgttctgatgctgccgctggtattcaccattgccgcagcggcgaatatcccgctactgtacgtcggcgtgccgatggccgcggcgctctccgtcacacacggcttcctgccgccgcacccgggtccaaccgcaatcgccacgattttccatgccgatatgggtaagacgctgctgtttggtacgattctggcgatcccgaccgtgatccttgccggaccggtttacgcccgtttcctgaaaggcatcgataagccgatcccagaaggcctgtacagcgcgaaaacttttacggaagaagagatgccgggctttggcgtcagcgtctggacgtcgctggttccggttattctgatggcgatgcgtgcgattgccgagatgattctgccaaaaggccacgctttcctgcccgttgccgagttcctgggcgacccggtaatggctacgttaattgccgtactgattgcgatgttcacctttggcctgaaccgcgggcgttccatggatcagattaacgatacgctggtctcttccatcaaaattatcgccatgatgctgctgatcatcggcggcggcggcgcattcaagcaggtgctggtcgatagcggcgtggataaatacatcgcttcaatgatgcatgaaaccaatgtctctccgctgttgatggcgtggtctatcgcggcggttctgcgtatcgcgctgggctctgcgactgtcgcggcgattaccgcaggcggcattgcggcgccgctgatcgccactaccggcgttagccctgaactgatggttatcgcggtcggttccgggagcgtgattttctctcacgtcaacgacccgggcttctggctgttcaaagagtatttcaatttgactatcggcgagaccattaaatcctggtcgatgctggaaacgatcatctccgtctgcggcctgatcggctgtctgctgttgggtatggtggtttaagcgaggcggcttgtaggccggataaggcagcaatgtgcgccaggattgcctgatggcgctgcgcttatcaggcctacgtgctctcaacataataaagccggggaaatccccggctttattatttcttcttcgcggccgcttttcggcgtttatccaaatccttaatcagcttgtttacgccctcatcggcaaacatctgctccagcgtggcagtgagcttccgtcgccagtttttatactgatcgctggtgcccggtacgttaaccggatcggccatatccagccagtcctccggctgaagccccaacagaccgctgttactgtcggctatgtagcgctgaagcccgcgatttagcgttggcgtcatcgacattaacgatgccttatgcccggcgcgttttggcagacaaccatatttatgcagcgcgtccaatagcccctgtttcgcccgctcgcgatcctcatacagcccgcgcagaatcacttcatccggataaagccccaaagctttacccaacgtcaggtcaccgcattcccaatagccgcgcagcgtggggagatcgtgcgtcgaggcgacagccatcgattgttgcggatatgcgcccggcgcgcggaagtttttctcaaggtcattttcaaaccacagcactttataagaatagaccccgctatcgcgcagcttgccgacaatctcaactggcaccgtccccagatcttcgcctatcaccatacagcggtgacgttggctctccagcgccagaatagaaagcaaatcatctaccggataatggacgtaagccccctgatccgctgtttcgccatacggtatccaccacaggcgcagcaacgacatgacatggtcaatgcgcaacgcgccgcagttttgcatattggcgcgcagcaggtcgataaagggctcatacgcccgggcgacaatgatatgcgggtccatcggcggcagcccccagttctgaccgagcgggccgaggatatccggcggcgcgccgacagatgctttcaggcagtacagctcccggtcgcaccaggtttccgcgccgccttccgctacgccaaccgccagatcgcggtacagaccaatcggtagtttaaaactctggcaggtatcccagcaggcggcgaattggcgccaggccagccactgaagccagaggtaaaactccacctcttcgcggtgcgcttcacagaattgttttaccgcgggatactctaccgactggtacgcctccggccaggctggccagccccagcgctgctcatcctcttttacctgatacgcatgcagcgcgtcgaatgccgcctgccagtaaaggctctcgccttcgcgggcgataaagtgacgaaactccgccatttgcgcatcgtcgcgagcggcaaaccgcgtccacgccatccgcagcgccgtgattttcagcgcggtaacggtagcgtaatccacccattgcgcatcgcgcgcctgtcgcagcttttgctgtgtggcgggcatttgccaccatgcctgcgcctcttcgctcaggcggaaatcttcgacggcgttgacgtcgatatatatcacgttcagccagcgacgagacgaggggctgtagggactggcgctctccggattcgccggataaagcgcgtggatcggattcaggccgataaacgcgccgccgcgtgtcgccacgtcgaccagcatcgacttcaaatcgccgaaatcgccaataccccagtttttttctgaacgcagagtataaagctggacgcaggccccccacagttttttcccttccagcagcgcctgcggctcatagcatcgcggcggggcgacgataatacggcagtgcgtacgctgttcatcctgggtcaacgtcagggtgtggtagccctccggcaatgtagccggaaggttaagttttttaccgcccgtcacgcgccctttgtaatgcacgccctcttccgtagtcagcagccaggcaaactcaccgcgcccctctaccggcaacgccatttttttacccgcggtataaaccttcacattcggcacgaccgcctgtggtcctgttgtcgtgccgtgcatcgccgccagcaaacgtctcttggtttcagcgccaatagactgcggtttgccatgagcattgatgtaactggggctgatccccgccgccagcgcggcactatcgagacgtttattttccatcgcgctcccttagcgttttgcctgccagatacgggcctgataatcgcgaatagagcgatcggaactgaacataccgcagcgcgcggtattgaggatcgcggcgcgcgtccacgcttcctggtcacgatacagcgcatccacctgcttttgcgcctcgacataagcggcgaagtccgccatgaccaggtacggatcgcccccctgtttgccgaggctatgcagcatctggtcaaaggcatgtttatcgccatcgctgtattgaccgctttccagctcttttagcaccgcatccagcactttgtcttttttacgccatttcaccggatcgtagcctttggctttgagcgccttgacctcttccacagtatggccaaagataaagatattctcttcacccaccttctcagcgatttcaacgttagcgccgtccagcgttcccacagtcaacgccccgttcagcgccagtttcatgttgccggtgccggacgcctctttcccggcggtagaaatttgctcggaaatatccgccgccggaatgagcatttccgccgccgagacgcagtaatccggcaggaaaaccaccttcagcttatcacccaccgccgggtcgttattaatggcttccgcaaccttattgatagcaaaaatgatgttcttcgccaggtaatagcccggcgccgccttcgcgccaaacaggaatacgcgcggtacgcgatcagcctgcgggttttcgcggatctctttgtacagcgccagaatatgcaacagattcagatgctgacgcttgtactcgtgcaggcgtttgatctgaatatcaaaaatcgcgttgcttgaaatctcaatcccggtacgggccttgatgaatttcaccagccgttctttgttcgcccgtttgatgtcgcgatactgctgacggaatttggcgtcgtcagcgtatttttcgaggttgatcaactggtcgagatcgttagcccactcttttttcagcgttttatccagcaacgccgcaagctgcggattgcactgtttaatccagcgacgcggtgtaatgccgttggtgacattgtggaatttgttcggccaaagctggtgatattccgggaacagatctttcaccaccagatcggagtgcagcgccgccacaccgttcaccgcaaagccgctgaccacgcacatattggccatgcgcacctgacggtcatgcactaccgccagttttgcccatacctgcttatcgccaggccaggtgttatcgaccagcgtcttaaagcgatcgttaatctgcttgataatctgcatatgacgcggcaacagcgctttcaccagcttctcatcccagcactccagcgcttctggcatcagggtgtggttggtgtaggcgaaggttttgctggtgatagcccaggcgtcatcccagctcagttggtgctcgtcaatcagcacgcgcagcagttccggaatggcgatggtcgggtgagtatcgttcaattgaatgacctcgtaatccgccagctcatgcagtttgcgtccggccagatgatggcgacgcagaatatccgctaccgagcaggcgcactggaagtattgctgcatcaggcgcagttttttgcccgccgtgtggttatcgttgggataaagcaccttcgtcagtttttccgcatcgataccctgctgttccgcccgcaggaaagcgccgtcgttgaatttggtcagatcaaacggatgcgcgtgggtcgcctgccacaaacgcagcggttgcgcgacgccgttacgatagcctaacaccggcagatcccaggcctggcctgtaatcacaaaacctggctcccagcgcccttctttggtgactttaccgccgatcccaacctggacgtccagcgcctcgttgtggcggaaccacggatagctgccgcgatgccagtcatccggcgcttccatctgcttgccctcaacaaatgactgacggaacagcccatactggtagttcagaccatagcccgtagcggactgcccgacggtggccatcgaatcgaggaagcaggcggccagacgtcccagaccaccgttgccgagcgccggatcgacttcctcttccagcagatcggtcagattaatatcgtgcgctttcagtacatcgctaacgtcctggtaccatcccagatttaacaggttatttcccgtcaggcggccaatcaaaaattccatcgaaatgtagttcacatgacgctggcctttcgtcggctgcgctaccggttgcgcgctcagtaattccgccagcgcgccgctaacggcctgccaccactgacgaggcgtcatgtcggacgccgacagtaaaccgaaacgctgccactgacgcgtcagggcggcctggaattgatctttattgaaggttggctgtgacataggaaatccgtcctcgggtaataaaacaacgttatcgctagtttgccaggctcgatgttgaccttcctcctcccggcaatgattagggagggaggaggagcggggatgagcataaaagtgtgatcgccgccacttacccctgtataaacgcgccgattcctgtcaacgacacccagtgttacgcataatcaaatgaataaacagaaataacagtaaatcgcgaaggggtattttcgaagattatatgaacgccgaaatagtttcttacctgaaatattcagcagcaggaggttcactaacttaacataattaattaaacgcctggtatcgccattgtgttaaatccggatgatgtccaggacattatttacaataacggaaatatgacctcagcccagctctgacgctcgtttcaaccgcgccgaatacttttttaataccgttatttagaattgtgacagagtgcaaattcagacacataaaaagtctgcttagcttgcattaaaatgctttctggccgaccttatatctattaattacgaagcgcaaaaaaaatcgcagttccccccatttcccacagtgaagtgattgctatgttgattccgtctaaattaagtcgtccggttcgtctcgaccataccgtggttcgtgagcggctgttggctaaactttccggcgcgaacaatttcaggctcgccctggtaaccagtcctgctggctatgggaaaaccacgcttgtctcacagtgggcggcgggcaaaaatgaattaggctggtactctctcgacgaaggcgataaccagcaagagcgattcgccagttacttaattgccgctatccaacaggccactggcggacactgctcgaccagcgaagcgatggcgcaaaaacgtcagtacgccagcctgacgtctctcttcgcacagctctttattgaactggcgcagtggcatcgcccgctttatctggtgattgacgactaccatttgattaccaatccggtgattcacgacgcgatgcgctttttcttacggcatcagccggaaaatttcaccctggtggtattatcgcgtaatttgccgcaactgggcatcgctaacctgcgcgtgcgcgatcagctgttggaaatcggcagccagcagttggcttttaaccatcaggaagcaaagcaattttttgaccgtcgtctttcgtcgcccattgaagccgctgagagcagccgcatgtgcgacgatgtggcaggttgggccactgcgctacagttgatcgccctctccgcgcgccagaaccatacctctgcgcatcactccgcccgccgtcttgccgggattaatgccagccacctttctgattatctggtggacgaagtactggataacgtggatgtcagcacccgacattttttacttaaaagcgcgatcttacgctcaatgaatgacgcgttgattgtgcgcgtgaccggcgaagaaaacggccagatgcggctggaggagattgagcgccaggggttattcctgcaacgcatggacgacacgggcgaatggttcagctatcacccgttgtttggtagctttctgcgccagcgttgccagtgggaactggcggcggaactgccggagatccaccgtgcggccgcggaaagctggatggaacaaggttttcccagcgaagctatacatcatgcgctggcggcgggtgacgcgcaaatgctgcgcgatatcctgcttaaccatgcgtgggggctgtttaatcacagtgaactggcgctgctggaagagtcattaaaagcgctgccgtgggaaagcctgctggaaaatccgcggctggtgttgttacaggcctggctgatgcaaagccaacaccgctacagcgaagtgaatacgctgctggcgcgcgccgagcaagagatcaaaggggtcatggacggcacactgcatgctgaatttaacgcgctgcgcgcccaggtcgccatcaacgacggcaatccggaagaggctgagcggctggcgaaactggcgctggatgagcttcctctcgcctggttttatagccgtattgtcgcgacctccgttcacggtgaagtgctgcactgtaaaggcgatctcagccagtctttatcgctgatgcagcaaaccgaacaaatggcgcgtcatcatgacgtctggcattacgcgctgtggagcttaattcaacaaagcgaaattcagttcgcccagggattcctgcaggccgcatgggaaacgcaggagagagccttccagttgatcaaagagcaacatctggaacaactgccgatgcatgagtttctggtacgtatccgcgcgcaattgctgtgggcgtgggcgcgccttgacgaagcggaggcctcggcgcgcagcggtatcgctgtgctgtccaccttccagccgcaacaacagttgcagtgcctgacgttactggtgcagtgctcgctggcgcgcggcgatctggataatgcccgtagtcagcttaaccgactggaaaatttattaggcaatggccgttatcactgcgactggatctctaacgccgataaggtgcgtgtcatttactggcagttaaccggcgacaaaaaatccgccgccaactggttacgtcatacgcccaaaccggcgtttgccaataaccattttctgcaagggcaatggcggaatatcgcccgcgcgcagatcctgctgggcgaattcgagcctgcggaaatcgtgctggaagagttaaatgagaatgcccgtagcctgcgcttaatgagcgatttaaactgcaatctgctgttactcaatcagctttactggcaatccgggcggaaaaacgacgcccagcgcgtattgcttgatgccttacagctcgccaaccgcaccggatttatcagccattttgtgattgaaggcgaagccatggcgcaacaattgcgtcagcttatccagctcaatacgctgccggagatggagcagcatcgcgcgcagcgcatcctgcgagagattaaccaacatcaccgacataaattcgcccattttgacgaaggcttcgtcgagcgcctgcttaaccatccggatgtcccggagcttattcgcaccagcccgctcacccagcgtgaatggcaggtgttagggcttatctattccggttacagcaacgaacagattgccggcgaactggcggtggccgcgaccaccattaagacgcatatccgcaacctctaccagaaactcggcgtcgcgcaccgtcaggacgcggtacagcacgcgcagcagttgctgaagatgatggggtacggggtttgaggcaaaacaggcaacgtcctggtgtgtaaatttgtttaatcataaaacctgaaagcaccggttaacatatgggcaaaaacggcgcttttaaaataaatcggcatgcgttcctgttcgttcaaatcgcaggcattcatccgttatcttataaataagaatccagtcaggctcaatatgggcatcccggtatccgctatatgaaccttgtaacgggtgatctttataaatggcaggaaggggaaaagggtggtgaatcagaagcgtcataagtgttttaagtttgccgacatccttatgacgcttttgtgcccgttttacatctttctggaactgtcccgaatattcaatttccctttgccccatagtcagatccctaactggtcaaacaaatcatcagcatctttggctttatgaatatcaacgccagcttcgctattttctatcgttcgggacgttaactcattgggtatgcgcaaatcaaaaggcaatgccttttcacgcgcaactttagtcagtgtaatccgtatcaaatcagaaatggttaaccccatttcagccaggacatctgccgcctggtccttcagcgtttcgtcgatacgggcacgaacaagcgcatttgcagccatcgattagtctcctgtactgtgtctctatacagttcaaattgtagctcaactgagacacacatacaaaccgggcccggatgtttgccttgcaatgctcgtaaagatgacttagtcgcttacccggacaagatagccactttcggttgcttcacaggaaaatctgaccggcaaaaaccgttccaccaccgcaatattggtaagcaagtgagcggaggcccgtgccacggtaaacgcgccctcgcccgccagcgccagcggtaaaatcagctggtcggccagatgctctcccaccgccgccgggcttgcgagatagcgccgcgcttcatgcgcaacctggttagctaccgcttccgcgctggtgccttttacgccgaacgcggcgaacagttcggtcagttgttcgctttgaatcatcagcgacagcgcgttgcccggcccgcagccgccttccagcgcaacgacgtttttctccgcctgcgggaagtgggcttccagcgttgcgacttcacgttcgccaacgtggtaaggaaccgccgccagcaaagcttcagcggtggtgcgcagcgtctcgccgcgcgatatcagcgtcagaccgcgtaaagacgctgccggttcgacgaccgttgccgccgcgccgccgcctgccggataaaagccgtgttttatcagcgtggtgcgctggctgatgcccatcctcgccaacagcggttcccagacgcggcagataaaatcagcgctgggcgcggcctgattatgcgtcccgccgtgaacctccacgcgggatgaaccgtcagcaaaccacagcgcgggcaggacggtttgcagcaccagcatacaactgcccgcgctgccaatcgcaaaacggtactcgccgccgcgaatcggccccggcgtaaaacgcaactgttgcgagcccagctcgtcgccgttcacctgcgcgccgcagatttccgttgccgctcgcaccgccgttaaatgctggcgtagcagccccggtttagcgcgcccggcgcggatgccgctcatttcaaacggctggccggttatcattgataaactcagcgccgagcgcaaaatctgcccgccgccctctccctgtgcgccatccagcgcgatgatccttgccattttctatcctttaacgcacaccacctgccgcagggcgtacatgatttcaaccaggtcggactgcgccgccatcaccgcatcaatatctttatacgccattgggatctcgtcgatcacgtccgcatctttacggcattcgacatgcgcggtggcacgaatttgatcgtcaacgctaaacagtttcttcgctttcgttcggctcatcacacgtccggcgccgtggctgcacgaacagaacgactcttcgttacccagcccgcgcacgataaagcttttcgcccccatcgaaccgggaatgataccgaactcaccgcgccgcgccgaaacagcccctttacgcgtcacatagatctcttcgccaaagtgctgctctttttgcacatagttatggtggcagttgatctcgtccatatcgagggcgctcggtttttccacgcagcgctggagcgccgccagcgcgttttccatcatcgcctcgcggttcaggctggcgaattgttgtgcccagtgtaccgctttcaggtaatcgtcaaaatattcgcttccttcattaaaatacgccagatcgcgggacggcagcgtttctaactgctcctgcatttcttgctgcgccaggccgataaaataggtgccgatggcgttaccgatcccgcgcgaaccggagtgcagcatgatccatacccgatcggtttcatccagacagatctcaataaagtggttaccggttcccaacgttcccaggtgcttatagttattggtattcaaaaagcgcggatatttttgcgttaaccactgatatcccgcttccagttgcgcccatttttcattaacgttggcgggcgggtttccccatgcgcccacatcgcgatgcccgcgtccggtggtacgcccgtgaggcacagcggcctctatggcgctacgcagatccgccagattttccggcagatcggccgccgttaagctggtacgcagcgcgttcattccacaaccgatatccacgcccaccgccgccggaataatcgcccctttcgtcgggatcacgctaccgatggtcgatcctttccccaaatgcacatccggcataacggcaatatgtttgaaaataaacggcattttcgccgtattgatcagctgctgacgggcatcgtcttctaccggtacgcctttggtccacatttttaccggtgcgttctgggtggtcattaattcgtaattcatcatttttttctcgttttaatcattagggtggcgacaagtttatgtgaatacaccgctctaccattgagctacagcgccgggctctgacgggtctcgaacccgcaacaaatgtagatccacaggcattcgccaaaatagggtggcacgacaagttaaggtgaatcacccgctctaccgttgagctacagggctaagccccggcagggttcgaacctgcgtctggccatacaaggtgtagatccaccagcatttgtgccttcagcgttgcgcgacaaattcatagccgggatgatacgcatcgggaaagatgtaatcccggccagcattcgcgccgcgctgaatactctttacaacgtcacggcttcaatctcttccagccagtgcgcgctgccatagtgaccgttaacaaagttatctatcaccgtaaacacctcgtcgctgaagccgccgacgttcaaaatatcgcttcgttccgccgcctgggtggtgccgtaaggcagcagatcgatacacaccaggcgcgcctgcgggttgcgctgaatactctttacaacgtcacggcttcaatctcttccagccagtgcgcgctgccatagtgaccgttaacaaagttatctatcaccgtaaacacctcgtcgctgaagccgccgacgttcaaaatatcgcttcgttccgccgcctgggtggtgccgtaaggcagcagatcgatacacaccaggcgcgcctgcgggttgcgctttttcagttcgatccagcattccatggtggccgttgagccatggcgcgatttatcaacccacgattcgttatccgacaccataatcaccagatccacccgcgcccgctcgttcaacaacctacgcagcggcgcggagcagttggtgccgccgccgccaaccgccgccagcttttgcgcgttgtgcatgaccgactggcgcgcatcaagccgcacgtcgaccacatcgcattcaaacggcagcacgcgggcctgcggatgattacgcagcacggcggcggcgatcagcccggcaacgtccacgcagcggatcttactggtctcccccttgcgatagccggttatcgacgacttcatcgaccccgacacgtccgggcagaccaccacattgccgcgaaacggcggaatgttctccagcgcgtactccatcgcctgcgctaaagcctcgcgaataacctgcggcacgccgctttgcagattgctccacgccgacagcaactgataaggataaacccaggactggcgcacctgcgccctgtccgccagccgctgcgccacgctggcggcaagcgttgcattctcaaacacgtcatgacgcgccagcgtattcaaattcatccgtaacgtttgccaactcatccgctgcgccagttgcgcccactgttcgcgactcagcggcgcgttggtcagtagtaaaaacgacacatcgggtaaggccgcgcccatgtcgccttcacgaaacgccagcagcgcgcgcgttttttccggcagctgcgccttatcgcacggcttaccaatcagccaggcgaagaaggcttcctgccacgccgcctgcggccgtgggtgcaccattttgacgatatccgccagcgacggcgcattgcccaccgatgcctgcaataagcgctcttcgctggcgttctgcaaccaacgctgcaccagcttctttggccgcgtccccagcgagcgccgcccggtcacgccgctgcgcaacatttgcacaaagttacgcagcatccggccattgttgatcacccgcgtaaatactaccggcagcagcgccgaaccacgcgccgccagaatggcggtcaacagcgcgggcatatccttcatcatcccgcgttcgcggccataaatcgccagttgcgctaaaaacagatcgtcgagatctttcgccgtcgccagaacatcatttagctgcgcctggccgctggcataaaaagtctcgttcatgcagccggtcatcaccatttgcgccagtttatggcgcggggtgaaggcaaaggccgctgcgccttgctgattgctggcgttggccagcggcgcgtcccttaacagcgaacggaacaaaagtggattagccatttgtttttcccatttccgttattctccatgccatggttattgcaaccagcgtgccagaaaataaattattttttaatctattgatttttaattgatttatttctttagcgttcaagtgaaagaaaaatgcctgcacggtagtcattaaaaagcgataaaattatctcgtcttttagaaggaaatctaagatgcgaaaaacggtggcctttggttttgtcggtacggtactcgactatgcaggacgcggcagtcaacgttgggaaaaatggcgccctactttgtgtctgtgccagcaggagacgctggtcgttcaccgcctggaactgctgtacgatgcccgctctcgctcgctgtttgaaggattaaagaaggatatcgccagcgtctcgccggaaacggaagtcgtcggcgtagaaatcgcgatccgcaacccgtgggacttcgaagaggtttacgcctgcctgcacgatttcgcccgcagccatacctttcatcccgaagatgaagactatctgattcacatcaccaccggcacccacgtcgcgcagatctgctggttcctgctggcggaggcgcgctatcttccggcgcgattagcgcagacctcgccgccgcgcaaaaaagataaaccgcatagcacgggcgacgtgacgattattgacctcgacctcagccgctacaatgatatcgccacccgcttcgcccaggagcgggaggagacgctcaacttcctgaagtccggcattgcaacccgcaacccgtgtttcaaccggatgattgagcaaattgagcgcgtcgcgatacgctcccgttcgccaatcctgctcaatggcccgaccggcgcgggcaagtcgtttctcgcccgtcgcatctatgaactaaaactggcccgccaccagttcagcggcccgtttgtcgaagtgaactgcgccaccctgcgcggcgacacggcgatgtcggcgctgttcggccacgttaagggggcgtttaccggcgcgagagaggagcgtgcagggctgctgcgcagcgccgacggcggcatgttgtttcttgacgaagtgggagaactgggcgcggatgaacaggccatgttgctgaaagccattgaagaaaaacgcttttaccctttcggcagcgaccagcaggtcagcagcgatttccagttgattgccggcacggtgcgcgacctgcgccagcgggtggcggaggggacattccgcgaagacctgtacgcgcgtattaatctctggaccttcgaactaccgggcctgcgtcagcgccaggaagatattgagccaaaccttgactacgaactggaacgccacgcggcgctaaccggcgacagcgtgcgttttaataccgaagcgcgccgcgcctggctgagcttcgccacctcgccgcaggccgcctggcgcggtaacttccgcgaactctccgccagcgtcacccgcatggcgacgctggcggacaacgggcgaatcacggtcgaaacggtagacgatgaaatcgcgcgtttgcgctatagctggaatgaccatcgcccctccgcgctcgacggactgccgggcattgacgcaacggcgctggatctgtttgaccgtatgcaactggaaaacgtcgttgcggtctgccgccaggcgaaaaccctttccgacgccgggcggcagctattcaacgtttcccgtcaggggaaagccacggtgaatgacgctgaccggctgcgtaagtacctggcgcgttttgggctgacgtgggacgttttacagaattaacacagctccagttgaatatggttctccgtcaacacctgcatcacgcccggcggcggcagggtatcggtgtagaccgcatcgaccatactaatgctgcccatgtttaccatcgcgttacggccaaatttagagtgatccaccaccagcatcacgtggcgcgaattttcgataatcgcgcgcttggtgcgtacctcatggtagtcaaattccagcaacgagccgtcgctatcaataccgctaataccgagaatgccgaaatcgagacggaactgggcgataaagtcctgcgtcgcttcgccaataatgccgccgtcgcggctacggagttcaccgccggcgaggataatacgaaaatcctctttcgccattagcgtgttcgctacgttcaaattgttggtcacgatccgcaaattactgtgccctaacagggcgtgcgctacggcttccggcgtcgtgccgatatcaataaacagcgttgaaccattggggatctgggccgcgactttgcgagcgatgcgctctttttcttccgtttgcgtcgccttacgatcgtgccacggcgtgttcaccgagctggagggcaacgccgcgccgccgtggtggcgcaaaatcatattctgttccgccagatcgttaagatcccgacgaatggtttgcgggctgacagaaaaatgctccaccagctcttccgtactgacgtacccctgtttttttaccagttcaatgatcgcgtcatgccgttgtgtttgtttcatgaataatctctgaaagtaaccaaccttgcgccggatagcggcattcgccctacccggcctggaaaaatatctcgaccacaggccggatacgcctcacgttcgttttcgcgcattcagcgtatcaacaaaggccatcgctaaaccgacgataagcccggcgatgtgcgcgccgttcgccatagacatgccaaaccagtcaaaccaaccagcgactatccacaataatgcaaaaataattaagccgcgctggaggtaaattccgctttgcggatcgcgctctccacgcagccacacgtaacccatcagcgcatagacgacgccagacagtccgccaaaccacgggccgctaaatttctgctgtacatagccgcttagcagcgcgcttatcaccgtaatgacgattaatttaccgctgcccaggcgcttctctaccgccccgccgagataccaccaccacagcaggttaaaaagaatatgcatcagtgagaagtgcataaagatatgggtgaagtagcgccagacttcaaattttaaaaccggatcgaacggccacgccagccacaccatcaccgtctgatcgccgatgagactcatcgcgatatagaccagcacgcaggcgagcatcacgatccaggtaacagggccggctcgttcacgcagcgtggcgagaaagggaaaacggcgatagcgtagcccgctgttagtctgcccggactgccagctagccgccagataacgcggatcgccgggattttctataaaccgcgccagctcgccccgcacacgttcggcctgcgattcatctgccaaccagatatcgctttgattatgttgctgaatagtaagaatgacgccctgggtggccatgtaatcaacaaatgcctgcgccacgcgaggattcgcaaaggaagtaatcatcaacattattgctgtcgcttagtccatacaaaagaagacagtatatatacccttctcgtcggaggctgcatctttatgggattacgcgccattcgcgacatcggcagggaaacggcgatgccaggcctcaaacccgccgtcaatgctgtaaaccgcatcatagccttgctggagcagatactgcgcggcgcctttactactgttgccgtgatagcacattaccatcacggcggtatcgaaaccatgctcacgcataaacgcgcccagcgtatcgttagtcaagtgaaacgcctgcggcgcatgacccatggcataactttgcggatcgcgaatatcgaccagcaccgccgcgccctggtgcagtttctgatacgcctcttctacagtgatacattcaaattgttccatgaatcgctctttcattattgccggtgaagccaattaaggcattttatcgcccagtgtacgttgacggagtagcttagcgccataatgttatacatatcactctaaaatgttttttcgatgttaccaatagcgcgtttctttgctattatgttcgataacgaacatttttgaactttaacgaaagtgcaagagggcagcatggaaaccaaagatctgatcgtgataggcgggggcattaacggtgcaggcatcgcggctgatgccgccgggcgcggtttgtccgtactcatgctggaagcgcaggatttggcctgcgcaacctcttccgccagttcgaaacttatccacggcggcttacgctaccttgagcactacgagttccgtctggtcagcgaagcgctggcagaacgtgaagtgctgttgaaaatggcgccgcacatcgccttcccgatgcgttttcgtctgccgcaccgcccgcatttacgtccggcctggatgatccgtatcggtctgtttatgtacgatcacctcggcaaacgtaccagtttacccggttccaccggtgtgcggtttggcgcagattcggtgctcaaaccggaaatcgtgcgcggattcgaatattccgactgctgggtagacgatgcgcgtctggtgctggctaacgcacagatggtggtgcgtaaaggcggcgaagtccttacccgtactcgcgcaaccgccgctcgtcgggaaaatggcctgtggattgtcgaagcggaagatatcgacaccggtaaaaaatatgtctggcaggcgcgcggactggttaacgccaccggaccgtgggtcaaacagttcttcgacgaagggatgcacctgccgtcgccatatggcatccgcctgatcaaaggcagccatatcgtcgtgccgcgcgtccataatcagaagcaggcgtatattctgcaaaacgaagataagcgtatcgtctttgtcattccgtggatggaagagttttcgatcattggcacgaccgatgtcgaatataaaggcgatccgaaagcggtaaaaattgaagagagcgaaattaattacctgttgaaggtttataacgcgcacttccagaaacaactggggcgcgatgacatcgtctggacgtactccggcgtccgtccgctgtgcgatgatgagtccgactcaccgcaggcgatcactcgcgattatacccttgatattcatgatgaaaacggcaaagcgccgctgctttccgtgtttggcggtaagctcacgacctaccgtaagctggctgaacacgcgatggaaaaactggcgtcttattatccaggcatcgggccggcatggaccaaaacgtgcgtactgcccggcggcgacatcgacggcagccgcgaagattacgcggcgaagctgcgtcgtcgttatccgttcctgacggaatcgctggcgcgccactattcgcgcacttacggcagcaacacggagtggattctcggcgaagccacgtcgctgcttgatttaggcgaagatttcggtcatgagttttacgaggcggaactcaagtacctggtggatcacgaatgggtgcgccgtactgaagacgctatctggcgtcgcaccaaagaaggcatgtggctgaccgccgaacagcagtcccgcatcacccagtggctggcggcgtatgttgagaaacaccaactttcaatggcgtcgtaataaaatccggggcggtttataccgcccttttcgccacataccgcattcactcgccgggttttgtacagccgggcatatgattagtgatacggtagcgatcgacacttatttgggtaataaagaagggttttgcccgcgcttcgctattccagagagttttccccgttttacaccagcttttatgagaaaagttggcataatgaaccacactctcctcccccagcacgctttcaaaatgcgcgcgtttatcaccgtcggccacgctaaagtcagcataaaaaagattgctgtccaggttaaacgtcatctctatttcactggcggacgatggaaagaacacaggcagccaggtccagataccggattgctcgggtatggcggcataatcaggaaaatagcttacctggcgatcatcgcaggcggtcagcacagcgatgatgattaatgctgcaccacaccggaggacctgattaatcagctcagcaacaatatctttatgccacgaagtggattcacgccgtgcaatacgaatatcagcgccgctggccgggtctatgccaacccgttccacatataatttaacctcttccatttagtccctttatttcgcggccggatacagcggcacatatcccacatcctgcaccaactgttgtccctgcgggcttagaaaccagtccaccagcttttgtgtttccgctgtggggtgttcacgggtgaccatataaacatcaaccgtgtacgggtaactgccgttacgaatattttcaaccgtcggcgcaacatcgtttatcgccagtaatttaatctctttattgctgtgcatctgcgtagcgtaataacgaaaggtatagccaatggcgttgtgcgtattgcgatactcagccacgatatccaccatatcccccatcgcggttgccactgatgttgtttgcgctggcatcagcttcgtttctttcattaccttcgccagcatcgccgtttggctgccagagttttccggtcgctgccagggcttaatgtcgattgcctctccgcccacctcattccagtgggtgattcttccgctaaaaatgccgcgaatttgtacatcactcaacgatgacacgggattgttttggttgacgataaacacaaacgcttcacgtgcaaagggggtgtaaaccagttttacgccactggcctcggccaattgcttttgagcagtggaaggctgggcgacaaaaataagatcggcattaccgttaaggatattttgataggcttcaatggttccctggttttcaaggtagtcttcagggcagatatcatccggaaagcgcgtaagcgcataaaaagccgaggcgtataacggcaagccagccgttgcgccatcgagccgcggccaattttgagtgagcaaaagtgtcggttcatcgcgcagcccggttagcttgttgccccatgtgtgcgcctgataatcgcggaaataaagatattcactgctctcgggagcgggatacttcacggcataaagatgtgactggtatacggcacagctcccgaaaaacagcaggcaaatcaccagcaggttacgacaagtgtagcccgcaccgccgcgtagcactccccaacgcgcaccgccataccctaatgcaaaacagagctgcgagccaaccgggatgagcaacactgcccatacccagccgttgaaaaaggatattacgcggggtactaaccaaagcgtttgcaccacctgggcgatgggcttacaccctatcgcgcgaatattaagatcggtgagaaacatcaggatgacccaccccatcagcaccaccagagcgggcataagcaggcagcaatcacgccattctggatttacctctgatgcatttccctttccccatatccggccacaaagaaaaattaaccctgcgcccagaagcgctaccgggataatggtcgcctcctcaatagatcgcgcgacggggatactattttcaagaacgctaatgtacgcccacattccccccacgataatcgtaataatgttcaccagcagcggcacgccgataaacgccattatgattgacaaaaaaagccaattagcatttttcatttttctatccgctaatccctgcgataacggaagtataaacccggtagtcctgagcccacccatgcatttttctgaaatcgcgacgttaaaacattcacgatagcggcagacagaagttgaaagttccggctgccgttttttatttacaggctcacattaacctgcaagatcgatctttttccgcgcctgcccaacagcatcggcggcccgcaatgccgcctgcacagcctccggcgtaatggtaaacggctcgttgtgtatcgtttccccagtttgacaagacgccctggcaacggccagcagttcatcatcgctaacgccagccagaccaatatccgccagcgtggtgggcaagcctatatcttcacaaaattgataaacctcctcgataagctcaggcgctctatcggtgagcataagcattgccagcgtgccaaacgcaaccttttccccatgccagtatttgtgcgtggcgggcagtactgtcagaccgttatgaatggcgtgcgccgccgccagcccaccgctttcaaaaccaagcccggataatagcgtattcgcttcgataacatgttcgagcgccggagtaacctgatgttgttcacaggcaagtttcgccaggcgtccatagcgcattaaggtggtgtagcaaaagcgcgccagctcaaatgcggtcatcggtcctggcctggtggtcatattgccggcccctttgatgcggcaatcttccgcttcaaaccaggttgccagcgcatcgcctatcccggaaaccaaaaagcgtaccggcgcggcagcaataatactgctgtccaccagcacaagcgtcgggttacgtggaatcatcaggtagcgtttgaatttcccttctggcgtatagataacaaccagtgaactgcacggcgcatccgttgaggccagagtaggaaccacggcaataggcagccgcaggctggcgccggttgcttttgccgtatccagggttttcccgccccccataccaacaatcacatcggcgccaatttcctgcgcgcgtgcggagatgcgagcaatttcctcatcacagcactcgctactgaacacttcgatatcaaattcaatcaccccgtgcagtgctgttgcaactgtatcccggtaggtgttgtgaacaacaggatcctgcaaaatcagcgccttatgaccgagtgcggccaattcctgcgggagatgcgttgtcaacgctcctttaccctgaacatatcgtgacggaaagatcgcggtagtaaccattgtttctccttaaaaagcattaaagttcaatatacagaacacaaattccacataaagaatttaatgctgtttactctgaacgcacaatgaccaggtgagagcataatcttatcctgtgaggcagcgcacaattttggcgatgtattagaccgatgagcagtttccattgggttatccgctctttctcaccttatctccgttcatttttgaagcaaatcacaaaatataaccttccttagagtatggaattgacgctgtatgaatacgtcggcatagtgtcaatatacagaacagaagttccatatacagaacacatttttgatactaaagggatgcaatgatgagcattgaaatagagaaaccgaccacacgagggcgctggctgcatattattccagccacgatcctcgtttatatcgtggcctatatggacaggaccaatatcgccattgggatcgcaggcggcatggatgaagatttaggcatgacggcttcttttgccggtctggtagccgggatcttctttattggttatatcttcctgcaaattcccggcggtcagatagccgagcggctaagcgccaaaaagttaattgcctggacaatcgtcgcctggggtggctttgccctgctgaccggttttgttcagacaccgacgcagttgttgattattcgctttgtgctcggcgtggcggaaggtgctgtgtatcccgccattctggcgctgattggccactggttcccaaatgaggagcgcgccagggctatcgcctatttccagatgaacctggccgtcgcttctattattaccgggccgctttccggctggcttattgaaacctacggctggcgggagatgtttatcatcgaaggcttgctctctctgggactgctctttgtctggctacctttggtttccgatcacccgcatcaggcaaagtggctggatccgaaagagcgcgcctggatcgaacaaaaattgctggccgatcgcgcgttgagtattggcggagaacaaagcagcattcgcggcgtattaaaaagcatcaacctgtggaagcttgtcggtatctatttcttcgtacaggtcggcttctatggcttcgcgctatggatgccaaatctgattaaacacctgaccggcagcggcatgaccatcgttggggtactcactgcggcgccttacgttctgtgcatcatcggtcagtattacatcgccaaatggtgtgataaaacgatgaatcgccgcctttacacggctattcctctgctgggtttcgcggtctgcctcgccctctccttattactgaaagataacgtctggctcgcctacggcatgatggttatttgcgggttcttcctgcaagcctatgccggtccattctggacgctgccgccattactcttcgcccccaacgttctgggcggcgtgcgcggcacgatcaacgccctgggcaacatcggcggctttatcggtccgtacctcgtcgggctgttaacggtgacgttctcgcaaacagcaggaatgaccgtactggttgccgccctgcttatcgccgttggactgcttttcagcttaccttctgttaccgctcgtcctgcaggtagcagcaacacccctaacacctcgacgccgggtgcgtcacttaaacaggaaggaatcgccaaatgagccaaaaatgtcaacatgctcgcgacctgtggtcgcagctcgacgccctgcgtcttggaatgaattacagcaaagaagatgtcaataaactgcaggtcctggtggatgattgctatggtgaaagtcatccgggcagtttccatcttaaccaactgggcgatgaagccgtgctgggtgttcatgaaagcggcggtcgcgcggtccgtcaccatgtgacggatatctgcgacggctggggtcagggccacgatgggatgaactacatcctggcatctcgcgaagccattgccaacatggtcgaaattcatgcctcagtggtgccttatgatgccggtattctgatctcaagctgcgataaatctatcccggcgcatctgattgccgccgcacgcctgaacctgccgctactgcatattcccggcggttctatgcgtccggcaccgaatatgagtacttctgacctcggtgggatcactgctaagttgaggaaaggcgaaatcggcattcagcaagtggaagccatgcagcaatgcggttgccccaccgccggagcctgccagtttatgggaacggccagtaccatgcagtgcatgtcggaggccttggggctggccctgccaggcagcgctttgctgccatcgaccctggcggaaattcgccgcgttgccagaactgcaggccaccaggcgctgtatctggcggagaaaaatatcaccacccataagatcctgactcctgcggcgtttgaaaatgctatcaaagtccatgctgctattggtggcagcaccaatgcgatgatccaccttccggccatcgctcatgaacttggatgggagctgaagcccgaactgtttgatcggatcaataacgaaatcccttatctgaccaatattcagcccagcggtgaatacgttaccgaaatgatgtggttcgctggcggcgtgccaatggtgcaatggtatctgcgcgattatctggatcttgatgtgcttaccgtgactggccgtacgctcggcgacaacctggaaatgctccatcaatccggcttctttacccgcaaccacggttacctcaacaattacaaagtcagtccggaggaggtgatccgtaaaccagaaaatgccaccaaaaaagggtcgattgcggtactgaaaggcaacatcgcgcctgaaggagcggtcattaaatacgcggcctgtgcgccggatatgcaccaccataccggtcctgctcgggtctttaactccgaagaagacgctcagcaggccatcatccataaccatatcgaacccggcgacgtcattttcattcgctacgaaggcgcaaaaggctctggcgcaccggaaatgctgatgactaccgatgccatagtgtatgacaaacgcctcgacggaaaagtcgcattgattaccgacggtcgtttctctggagcgaccagcgggccatgtgtcggacacgtctcgccagaagccgctgatggggggccgattgccctggtggaagatggtgatttaatcgaaatggatgtgaaaggccgcaagctcaatattgtagggatcgacgggatgcctaaaacagaagaggaaatacgccgctgtcttgaagagcgtcgagcaagctggaagaaacctgattattcaaaccgtcgcggcgtctttaaacagttcaccgctaatgcaacatcattaatggccggagcctggcttaaataatatccctggcgggctacggctcgcctgttttaaggatcaatacatgactcagattacgaaatttcacggcgtatttccgccagttccgaccattgttaatgcgcagggagagttagataaagtcggcatggcaaccttgctggatcatcttattgcaagcaaggtcaatggcgtattactgctgggcagtggaggggaattttgccatatgaccaatgcgctgcgtctggaaaccgcagagttttgcgtccgtcatattaaccgccgtattccagtactattaggtattagcagcaccagcacgcaggaagtgattgagtatggtcagcatgccgaccgactcgaagtcgatgccgtgctggtactcaatccctactatgccagattgaccgatgagtatatttatcatcatttcaaaaccgtggctaataacataaaaagcccggtgattctctacaactttccagcattgacgggacaggaccttagcgttgatttaattacccggctggcgcaagatcaccccaatattatcggcattaaggataccgttgataatatcagccatattcgtgaaatcatcaataatgtcaggccagtgcgtccggacttcgttattttctccggctatgatgaatatatgatggatacgcttatcttaggcggcaacggcgggatcccagcgacagcgaactttgcgccacagctaacctgcgggatctaccgcgcgtggtgtgaaaaagagtatgagaccatgttcggattacagcgcaggctgtccgcgctttccactatttacagcctggattcacctttcttcgggataatcaaaaaggcaattcagcttagcggagtcgatatttcaactcatgtaatgccccccgttttgccggcaaatgaagaacatatttcgaatttgaagcagatcttacagcgtgcgggactttaagcgatgacgaaagcgggcttcttgcccgctatgtctttttatttcagcacatcagacgcgtcaggctacggctggcatccatcatcagcgtagcaagcgactcgcgtttatcatcggggatctggaacgtaacgccggatacgctcagggcggcgatcactttcccctgcgtattgaataccggcaccgcaatgcagcgcacgccaagggagtcttcttcgttatcataaccccagccgcgacggcgaattcctgctaactcctgcttaaggatattcacatccgtgatcgtcgtatccgtaaaacgcgttaatatctgatctggaggcagcaactcctccagctcttccccgctaagccatgcaatcagcacctttcccagccctgagctatgtaatgagaggcgcttgccctcccagcttcgaatcacaatagcctgtgggctttcgactttcagaaggtaaataggggcatcgccctccagaacgccaagatggcaggtcaggccggtgttatcgcgaatctcttcaagaatcggtaacgcgatttttttaatatcgtactgttccgccgctttattacctaattcatacaggcgtagccccagataatacttgtctttttcctggcgtaataacccatgctccaccatgccgttgagcaaagatgaggtactgcttttcgcaatccctgaattttgatggatctgggtaaacgttgcgccatcgcactccagaaggtaagcaaatacgcgcataattttatcgagagccggaatagatgtcgtaatctttttcatattattatcaattaattatggatttttctgctaatactatacaccagtactcgaccctttttccatgacagagaccaagtgccgctaacagattcagcagacgaatatcggcataccccccgaatataccacgataaaaaacggggccgtttggccccgttctcaagcgttaaaccgctacaaccgcaccggatcaatatgccagatattttcggcatactctttgatggttctgtccgatgagaagtagcccatattggcaatgttgagcatcgctttcgtcgtccattcttccgggcgacgatacaactcatccaccttatcctggcagtccacgtagctgcggtagtccgccagcacctgatagtgatcgccaaagttaatcagcgaatctaccagatcgcggtaacggcctggctcttccggattaaagacgccgctaccaatctgcgtcagtacctgatgtagctcttcatctttttcataatagtcgcgaggcttataaccctgcctgcgcaacgcttccacctcttcggcagtattaccgaagataaagatattctcctcgccgatatgctcctgcatctctacgttcgcgccatccagcgtaccaatggtgagcgcgccgttcagggcaaatttcatattactggtgccggaagcttctgtccctgccagcgaaatctgctcagacaggtcggcagcgggaatgatcacctgcgccaggctgacgctgtagttcgggataaacactactttcagcttgtcgccaatctgcggatcgttgttaatcactttcgccacgtcgttgatcagatgaataatgtgttttgccatgtaataggcggaagccgccttaccggcaaaaatattcacccgcggcacccagtcggcctccggattttctttaatgcggttatagcgggtaatgacatgcagtacattcatcaactgccgcttgtattcgtgaatacgcttaatctgcacgtcgaataacgctttagggttcaccaccacattcagttgttgcgctatcactaccgccagccgttttttattttccagcttcgcctgacgcaccgcatgattgaccagcggataatcacaatgctgcttcagctcgctgagctggctaagatcggtacgccaggtacgaccaatattctcatccagcacgtcagaaagcggcgggtttgccagcgccagccagcggcgcggcgtaacgccgttagtgacgttacaaaaacgggtcgggaaaatcttcgcaaaatccgcgaacagcgactgcaccatcaggttggaatggagttcagaaacgccgttgactttatggctgaccaccaccgccagccaggccatccgtacccggcgaccgttcgactcatcaataatcgacgcgcgtccaagcaggctggtatcgttgggatattgctcctgcaccgttttcaggaaatagtcgttaatctcgaagataatctgcaggtgacggggcagaattttccccagcatatcgacaggccaggtctccagcgcctcgctcatcaacgtatggttggtataagagaagacctgacagcacacctcaaacgcgtcgtcccagctaaatttatgttcatcaatcagcaggcgcatcagctcaggaattgacagcaccggatgcgtatcattgaggtgaatggcgattttatccgccagattctcataggttttatgcagttgataatgacggtgcaggatatcctgtaccgtcgccgagaccagaaaatactcctggcgcaggcgtagctctcgtccggaataggtggaatcgtccggatagagcacccgtgaaacgttctcagagtggtttttatcttccaccgccgcaaagtagtcgccctggttgaatttaccgaggttgatttcactactggcctgcgcattccacagccgcagtgtgttagtggcgtcggtgtcgtaaccggggatgatctgatcatacgcgacggccagaatctcttccgtctcaatccagcgcgcttttttaccttcctgctgaatgcgcccgccaaaaagcaccttatagcgcgtattgtggcgcttgaactcccacgggttgccatattccagccagtaatccggagactctttttgccgcccgtcgacaatattctgcttaaacatgccgtaatcgtagcgaatgccgtacccgcggcccggtaatcctagcgtcgccagcgagtccaggaagcaagccgccagccgtcctaagccgccgttgccaagccctgggtcattctcttcatcgatcagctcttcgagatctaagcccatggcctccagcgcgcctttaacgtcgtcataaatgcccaacgagagcagcgcgttagagagagtacgaccaatcaaaaactccatcgacaggtaataaacctgccgggtttcctgcgataattgggctcgattagaacgcagccagcgctccaccagacgatcgcgcaccgcgaacaacgtggcgttcagccattcgtgtttattggcaatgaccgggtctttaccaatcgtaaacatcagcttataggcaatagaatgcttaagcgcctcaacgctgagagtgggcgatgcataagtaaacggagcattcatataaatgattcctggatgactatttcaagcgatagtacagctcgcggtatgatttcgcggcaacttgccagctaaaatccatcgccatcgcctgccgttgtacaaaccgccaaagcgaaggccgtgaccacaacacaaaagcacgccgaatcgcgcgtagcaacgaccaggcattactgtcttcaaagacaaaaccgctggcgataccgtccgccagattttccagcgaactgtcggagaccgtatcggccaaccccccggtacgccgcaccagaggcagcgtgccatactttaagccatataactgcgttaagccgcacggttcgaaacgactgggcaccagaataacgtccgcgccgcccataatgcgatgcgagaaagcttcgtgatagccgatctgtacgccaacctgccctgggtgttccgccgccgccgcgaggaacccttcctgaagcaccggatcgcccgcgccgagtagcgccaactgcccgccctgctccagcagccccggtaacgcctccagcaccagatccagacctttctggttggtcagacggcttaccacggcgaacagcggcactttgtcgttaaccttcaaccccatcgcaatttgtagctgacgtttgttttccgccttctcttccagggtatcgcgcgtgtagcgcgacgccagcagcagatcggattccgggttccagatcttctcatccacgccgttcagtatgccggacaagcgcccttccagatgacgctgacgcagcaggccttccataccataagcaaactgcggttcagtaatttcacgcgcataggtcgggctcaccgccgttatatggtcggcatagtacaaaccggccttcaaaaaggagagttgtccgttgaactccagcccatgcatattaaagaatgaccacggcagttcgatgtcatccatatgctttgcataaaacatgccttgataggccaggttgtgtacggtaaagaccgatttcgccggccgcccgcgcgccgccagataggcgggcgccagcccggcgtgccagtcatgggcgtgcaccacgtcggggcgccagaatggatcaagtccgcaggccatttcacagccgacccaccctaacagggcaaagcgcagcacgttatcggtataggcatataaattcgtatcgtgatagggactgcctggacgctcgtacagatgcggcgcgtcgatcagataaatgcccacgccgttataatgcccgaacagcagcgatatcttacctgcgaaagtatcgcggcggctcaccacatgcgcgtcgggtatcccccgacggatatcgggaaaccctggaagcagaacgcgaacatcaacaccatccgcaatttgtgccgcaggcaacgcgcctatcacatccgccagccccccagtcttcagcagggggaacatctctgaacatacatgtaaaacctgcattatcgctcctgtttgacctgcagtttgcgcagcatttcacgcgtgaccagtacaataccttcttctgaacggtagaaacgacgagcgtcctcttccgcattttcaccaatcaccatgccttccgggataatacaggcacggtcaataacacagcgacgtaaacggcaggagcgccctacccaaacctcaggtaacaacactgccgaatcaatattacaaaaagaatttattctcacccgtgggaagagcacagattgcaccaccaccgaaccggagataatgcagccgccggagaccagcgagttcagcgtcataccgtggctaccggagcggtcctgcacgaatttcgcaggcggtagcgattccatatgcgtacggataggccagttctggtcatacatatccagctccggcgtcaccgaggctaaatccaggttcgccttccagtaagcttccagcgtacctacatcgcgccagtacggttcggcttgtggatcggactgcacgcaggagagcgggaaaggatgcgcgtaagccataccttcgcgggtgattttggggataatgtctttaccgaaatcgtggctggaagcgtcatctttatcgtctgccgccagcaattcatacaggtaatcggcgtcaaaaacgtaaatgcccatactggccagcgatttgctggcgtcaccaggcattgcggggggattcgccggtttttcgacaaaatcaataatcttgtcgctttcatcgaccgccatcacgccgaacgccgtcgcttctttgatcggcaccggcatacaggccaccgtgcaacgcgcgcccttttcaacgtgatcgatcaacatacgcgagtagtcctgcttgtagatatgatcgcctgccaggatgacgacatattccgctttatagcgacgaataatatccaggttctgggtcaccgcgtctgccgtgccgcgataccagttttcgcccttcatacgctgttgggctggcagcagatcgacaaattcgttcatctcttcgctaaacagtgaccagccgcgctgaatatgctgcaccagcgtatgggactgatactgagtgatcacgccgatacggcgaatcccggagttcagacaattagataaggcgaaatcgatgatgcggaacttcccaccaaagtggacggctggtttggcgcgtttgttcgttaaatcttttagacgcgtgccgcggccgccggccaggattagggcaacagatttcaatggcagctggcgcgccaacattacacgatcgttcttctctaaactcaccatgattaactccttttttatcctctctggaacacacacagtccatgcgcaggtccctgccagaccgccgttatcaccggattatcctctccagcgaatgggggaacggcgcgccattccccttcgggtaaaactatatctgtcacctcaagcgtggcatttatcgcaatcagaaaacggtccgacaacagaatttgcatcagcttaggcccgttttgccactcatccgcactcaagggttgcgcgtttttattcagccaacgcacgttgccatcgccttcttcccaccagctattgccggttaaagccggtatctgctgacgcaaacgaatcagcgcggcggtaaacgtggttaacccacgatttgcctgctgccagtccagccaggttaaggcattatcctgacagtaggcgttattgttgccatgctggctatggccgtgttcatcgcctgccagcagcatcggcgttccctgagagagcagtagcgtcgccagcagggcatgaatgctgtcgcgccgccgctccattaaatcaagcggaccgcctaatccttctttaccatgattgtcgctgtaattgctgttggtgccgtcgcgattttcctcaccgttcgcctcattgtgtttctgattgaaacagacgcagtcccggagcgtaaaaccgtcatgcgccgtgagcagattgacagaggcgccgggcgcgcggccattgcgtttaaacacatcgctggaagcggcgaaacgacaggcaaactccccggtcgtcaggttacgcggcaaccagaatcggcgggccgcatcgcgaaaatgatcgttccactcggcaaacggtggcggaaaattcccgacctgatagccgccctcgccaatatcccacggttcagcaatcagcttgaccgttgataacacaggacacgctttaatcgcggcaaacagcggcgcatcctggcgaaacgtcggcgtgcgccccatgacggacgccaaatcaaaacgaaaaccatcgacatgacaggtttccacccaatagcgcaaacactcgcacgcgtattccaccacgccgggatggcttaaattgagcgtgttgccgcaccccgtccagttgtgataatcgccatcgtcccttatccaataatagctacggttatcaattccgcgcagggagaaggttggaccgtccagatccagctcggcgctatggtttaatacgatgtccagaatgacctcaatccccgcacgatgcagcgctttcaccgcatcgcgaaactcgtccagcgccgtctcgggcgaactggcccaggcgggatgcagcgcgaacatcgccatcgggttataaccccaataattggtcagccccatacgttgcaggcgcggctcgctggcaaactgcgccaccggcaacagttccagcgccgtaatgccaagctgtttgaagtacgccaccatgaccggatgaccgagcgctttataggtaccgcgtatctcctgggggagctccggatgcaggtaggtaagccctttgacatgcgcttcatagatgaccgtttttccccacggcgtgcgcggcgcggcgtcatcttcccagtcataatggtcgctgattaccacgcttttcggcgccaccgccgcgttatcgcggtagtccggttcatcgtgtccgccgtgcaacagcggatgatcttttagttcgccctcgacccggcgcgcataaggatcaagcagtaacttcgccggattaaaccgatgcccctgcgctggctgccacgggccatgtacgcgatagccatagcgcaaacctggcctggcgccggccagataaccatgccagacatcgccgcgacgtcctggcaggtcatagcgacgctcattccctcgggaatcaaaaacgcacagctctacgcgctccgcatgggcggaaaagagcgtgaaattcacgccatgaccgtcatacgttgcgccatgcggcgttgcttcgccgatcgcaagctgcgtcattccccctcccgcatcagccagatcgtcgccaacggcggtaacgtcaggttaagagagtgctgacggccatggctttcgatctcatcgctgtgcaccacgccgccattgccggtgttgctaccgtgataatgcatcgaatcagtattgagaatttcacgccagcgtcccggctggttgatgccaaagcggtagtcgtggcgaggaacgggcgtaaagttgctggcgacgatgatctcgttaccggctttatcacggcgtacaaaaatcagtaccgagcgttcattgtcatcgaccaccagccactcaaagccgtaagcatcaaaatccagctcatgcaacgctttatggtggcgataggtgtggttgagatcgcgcaccagacgctgaaccccgtggtgccagttatcgcccccctccagcaggtgccagtcgaggctggcgtcatggttccactcgcgtccctgggcaaactcattccccataaacagcagtttcttgccggggaaggcccacatccaaccataataggcgcgcaggttggcgaatttttgccacgcatcgcccggcatacgatcgagaatggatttcttgccgtgaaccacctcatcgtgcgacagcggcagaacaaagttttcggtatggttgtacaacataccaaaggtcagcttgtcgtgatgatactggcggtacaccgggtccagcttcatgtagtccagcgtgtcgtgcatccagcccagattccacttgtaccagaaccccagcccacccgtttccggtggacgcgtcacgccagagaagtctgtcgactcttccgccatgctgaccgcgccgggcacctgctcgccaataatgcggttggtattacgcagaaactcaatggcttccaggttttcacgaccgccgaactcgttcggtatccactcgccctctttgcggctgtagtcgcggtagatcatagaggccaccgcatcgacacgcagcgcatcaatcccaaaacgctccatccagtacagggcgttacccaccagataattactgacttcacgacgaccatagttgtagatcagcgtattccagtcctggtgatagccctcgcgcgggtcgctgtgctcatagaggtgggtgccgtcaaactccgcgaggctaaattcatcggacgggaaatggcccggcacccagtcgagaatgacgttaaggcccgccgcatgggccgcattgatgaaataacggaagtcgtctcgcgtaccaaagcggcgggtcggcgcgtagaggccggtcggctggtagccccaactgccgtcaaacggatgttcgttgaccggcaagagttcaaggtgagtaaagcccatccatttggcgtaaggcacaagctgatccgccagctcacgatagctcagccagaaattgttatccgtatggcggcgccatgaacctaaatgcacctcataaatcgagatcggcgcatcaaactgattggctttttgtcgttcttcgcctggcgtcactttctccggcagtccgcaaatcatcgacgccgtttccggacgcatctgcgcctcaaaagcatagggatcggctttaatgcgcagattaccgttcgcatcaagcagctcgaatttatacagttgtccattatgcgcgccggggataaacagctcccaaataccgctctctttgcgcagacgcatcgggtggcgacgcccatcccaatagttgaattgcccgacaaccgaaacgcgacgagcattaggcgcccagacggagaaacgggtgccggtgacgccatccatcgtatcggcgtgcgcgcccagcgtttcataaggacgcaggtgggtgccttccgacaatagccaggcatccatttcctgtattaatggaccaaaacggtaaggatcgtcgatgaggttctgctgtccgtgccaggtcacggcgagctgatagcgaaagaaatttttacgtcggggtaaaacgccgcagaaaaaaccgcgagcgtcgagacattccagtttgccgactttacgtccggttttgggctcaatcacccatacgtcggtggcgtcaggtaagagggcgcggacttctagtccggcttgggtctggtgcattccgagtacggaaaaagggtccgcaaaatgtcctgcaattagcgcattaatcacgtctctatcgatacgactggacatggtttgtcatcctgttttgtggcgtcactccatctcactgaattcaacatcaggtagtgacacttctttgacctgaacggcgcagcacactgtgcatcctatctgcgtcgtcctaccttcaggttaggcttaatacccgtgggattaagctacccttaaagaatagccaatgctctgcttaactcctgataaaaatgaaacatctgcgtttactcctgtattacgcaaaaaaagggtgacgatgcacccctggtttaacacaaatttccccgccggatggcggcgctgacgcgccttatccggcctacagaaccacacgcaggcccgataagcgctgcaatagccactacgccaactggcgcagcattcgacgcagcggctcggcggcgccccataacaactggtcgcctacggtaaacgccgacaagaactctggccccatgttcagcttacgcagacgaccaaccggcgtagtcaacgtgccggtcaccgccgccggggttaattcgcgcatagtgatatcacgatcgttcggcaccactttcgcccacggattatgtgccgccagcagttcttccaccgtcggaatggatacctcttttttcagcttgatggtgaacgcctggctgtgacagcgcagcgcgccgacgcgcacacacaaaccatcaaccggaatcacagaggcagtattgagaatcttgttggtttccgcctggcctttccactcttcgcggctctggccgttatcgagctgtttgtcgatccaggggatcaggcttcccgccagcggtacgccaaagttatcaaccggcagctcgccgctgcgggtcaatgccgtaactttgcgttcaatatcaagaattgcggaagacggcgtcgccagttcatcggcgacatggccatacaactgacccatctgggttaacagctcgcgcatatggcgcgcgccgccgccggaggcggcctgataggtcgcgacggatacccagtcaacgagattatgggcaaagagaccgcccagcgacatcaacatcaggctaacggtacagttaccgcccacaaaggtcttcacgccattgttcaggccgtcggtaatcacgtcctggttgaccgggtcgagaataataatggcatcatctttcatgcgcagcgtagaagccgcatcaatccagtaaccctgccatccgctttcgcgcagctttggataaatttcgttggtataatcgccgccctggcaggtcacgatgatatcgagcgcttttagcgcatccagatcaaaagcgtcctgtagcgtgccggtggaggtgtcgccgaaggtgggcgccgcctgtccaaactgggaggtagaaaagaaaacagggcgaatagcgtcgaaatcgcgctcctctaccatgcgttgcatgagaacagagccgaccattccgcgccagccgataaaaccaacatttttcatagcgtttttttcctgcaaagagatgtgctgtgtatgcgcgccagtatcctgtggcgcatccttcaccatacaaaaagcagccaaagtcgcaagtgaaattaatcaatgatagcgaagccatcagtaatgcgacttatcctgccttaccgcgcaagcagaaagtccagtggcgattatcagggaatttgcgttaggaagggaatcatttccgtcgctgttttattgatcctaattatggatcagcgtagaaatttgcctgcttttatgcgcgtactgaaacatggcgaggcaaaatgtcgttgggcgattgccatgcacacctcaataaaaaaaccgggtagcgattacgccttacccggcttacggtgtcgatatgtgcccgtttccaggcccggtaagcaccgcgccaccgggcaacaagactcagctcagcagttggaaagcaatcatcccgacaatcgcgccgaccgtaccgaggatagtttccatcatcgtccaggtttttaacgtctgcgcttcggtcgcgccggtaaatttaccgaacagccagaagccagcgtcgttaacatgagaaaccacaattgaaccgccggcgatacagatagagagcgcagccatctgcgcgccggagaaattcagttgctctatgaccggcatcaccagaccgaccgcggttaaacacgccacggtcgcggaaccctgaatgatgcgcactgccgccgccagcacaaagcaggtaatggcaatcggcagtcccataccggttaacgcttcgcccagcgccgggccgacgccggagtcaaccagtacctgtttgaacaccccgcctgcgccaatcaccagcaggataatgcccgccggttgcagcgcgtggccacagatttccatcactttgtctttcggcatcccctgacgcatcgccaggccataaatcgctaccagacaagcgaccagaatcgcagtgaaggggtgaccgataaactcaaaccattcgtaagcggtggaaccttccggcacaaaacgcgcggcgatcgttttcagccctaccagcaccaacggcagcaggatcagcgacaggctgaagccgaaagaaggcattttgccttcgcccagatgcggctcggtaatgtcttccggtacatgcagttcaacgtaacggctgatgaaattgccccacagcggcccggcgataatcatgcccggaatggctgcgcacaggccaatcaggatcatccagccaaagtcagcgtgcatttgggatgccagcagcatcggcgcaggtcccggcagcaggaacgctgcggcagccgccacgcccgcaaacagcggaatgaccagcttcaccaggttcgttccggtgtggcgcgccattgagaacgccacgcttatcagcagcacaatcgccacttcaaagaacagcggtagcgcgcaaatcagaccggccaggccaatggcataatgcgcgcggctatgaccgaaagatttcagcatcttgacggcaatctgatcgaccgcgccggtctcgtgcagaatcttgccgaacatcgcccccagcgcgaccacaatcgccaggaatcccagcgtgccgcccatccctttttccatggtcgcggcgattttatcaagcggcatccctgaaaaaagccccgcgcccatcgagacgaccattaacgcgacgaaggcgtgcatacgcgccttcatcaccaaaaacagcagcagtaagacggaaccgacggcggttaaaaccagtgttaatgtactcacagcgtactgcctttattgatgacctcaatggtgctcgccacgacgccttccagcggctggtcgatatccaccaccagaacatcgcgttcgtcggcacccggctcttgcagcgtttcaaactgcgtcaccagcatttgggttttgaagaaatgacctttgcgcgctttcagacggctttcaatgacgtcgaaatcacctttcaggtagataaaggagaggttcgggtttccctcgcgcagcaggtcgcgatagtgttttttcagtgcggagcagacgatcagcgagattttattggtacgctgcatcgcgaaagcggcgtcgttcagcgcctgtaaccacggtttgcggtcatcatcattcaacggctcgccggaagccattttttcaatattgcagcgcggatgcagaaaatcgccgtccagaaacgcggcatgaagctgatgcgccacggcgcttgcgacagcggatttaccgctgcctgatacgcccatcagaacgtaaacgtggtgatcatgattagtcgtgctcaaagcgggcccccactctacaagttgcaaaatttgttacgggtaactgttatcggtaacattgtccaaccgcaccattcacgacgcaatgaccattcgtgccaaaagtgaataagtgtgagctacttcaaagttgtcagactaaatagatccgcccggtgacaaggtgaaacctaaatctaacattttcggcgtgaccgtttcgccgcgaatgcgggccaacagacgttccgcgccaatgctgcccattcgctcgcgtggcgtcaggacgcttgccagacgcggttccatcacctggccgatgtcatgaccgtggaacccggcgatcgccatgtcgtccgggatttttagccccaggcgctggcattcgaaggccgcccccaccgccaggtcatcgttggtgcaaaaaataccgtcaagctgtgggtattcgcgtcgcgcctggcgcatgagttcgataccggaagagtaggatgaagattgctccatcatcacactgtaaggaaccagccctgcgtcccgcatcgcctgttcatagcccttctgcttgatgatagtacgttcgtcgaggcgcgcccccagataggcgatatgacgatgaccacgcgcgataatcgcggcggtcatctgacgggcggcctcgaagttatcaaaaccgacggcaatatcgagacacggcgactggctgtccatcagttccaccaccggaatcccggcgacttcgatcatttttaaggtgcgcggcgtatgggtacgctcagtgaggatcaggccgtcgatattccaggagagcatcgattccaggcgctcctgctccatctccggtttatagccgtagtgcgccagcatggtttgataaccatgcgcgtcggtgacagcctcaatgccgcgtaacacttccgcaaagacctggttggttaaagacggcagcagaacgccaatggcgcgactggtggcgttggaaagaatgtcaggcgcgcgattaggaatgtacccgagctcatcaagcgcagccgcaattttaccccgcagcgcgacggagacctgctccggattacgcaaaaaacggctgaccgtcattttggtcacgcccacacggtcggccacatcctgaagtacgggtcttttctttttcatcgtcctgaaaggtataaaagggatagatttgcccagtttaccacggacatgcggaattaatgacaaacgatgaaaagccggatggcaacgctttcgcgtcttatccggcctacaaaaggttacagcacgttaaactggcggcaagtcaaacagcaacacttcactgtcgctgtcggcatgaatcgagattgcctgctcatcccaaatcgccaggccgtcgctggtggtggctttggtgccgttaatggtcacgttaccttttaccacctggatccagacgcggcgctcagcggcaatctgatgcaccgactgctcatctttgagcagcgcccagcggtacagctccatatcctggtggaccttcagcgaaccatcgcgagcatctggcgaaagcaccagttgcttgccctgcgcggcgtcgaagcggcgctgttcgtagcgcggcgtgatgccggtttcttgcggaatgatccagatctggtacagccgcagacgatccgttttgctcgggttgtactcggagtggcgaacgccggtcccggcgctcataatctggaattcaccggccggaacctgttctttattgcccatactgtcctggtgttctacggcgccttccagtacataggtcaaaatttccatgtctttatgcggatgcgtgccgaaaccctggcctgcgtcgatcacatcgtcgttaatcacacgcagcgccgagaaccccataaagttcggatcgtaataatcggcaaaagaaaaggtatgccaggagtcaagccagccatgattcgcatgaccgcggtcgtttgctttgcgtaagtagatcattgtgttcacccccagatgttttcgatggaataagtgtggactcattccgtccgggatcatagagggtgaaaattgactcctctgttcaaaaaatatgaataagcgcagaggagtctgtaagggctatttagccagggttatcgtcgcaggcgttgcctgttcgaaggcacgttcgaggatttccaggttggtaagaacttcagattccttgacgtaattaggcgtaccgacggtcaacgtctggtacagcgcatcatagacgcgaccatagtcacccgtttccggtttcacctcttctttcaccgtaacgccgtcgtcattgacatactccagcacgccgacggattcgtcagcggcgaaaccgggttcaccaggcataatgttcgctttcaggctggtttcttgttgatcgataccgtatttcacaaacgaacctttggtgccgtgaacaataaacttcggatagtcgattttcaccagatggctggttttcacaatggctttcaggtcaccgtagaacaattgcgcttcaaaggtgtcatccggattcgctttattacgcaggctacgaatgtcatacgcgacatgatccgggcggccaaatagcgaaataatttgatccatagtgtggacgccaagtccgtagaaagcgccatcctgcggcaggcccggtttggtttccgccacgggtcggtagtagtcaaaatggctttcaacttcgacaatcttgcccagtttcccgctctcaatcgcttttttagcagtgagaaaacaggaatcaaaacgccgattctgatacggcgtgacggtcagtcctttgcttcgcgccaggtcgaacaacacttttgcctccgccagcgtcggcgtgaaaggtttctcaaccagcacatttttacccgcttccagcgcgcgtttagcgtattcgaaatggctgtcagcatgcgtacagacgatcaccagttttacctgcggatcgcccaacacctcatccagatcgctggtgaagtgaatatgcgaatactgcggcgcctgctcttccggtttagcgtgacgacggaaaatatgcgcgacatgccaggtatctttccgattcagaacataggggagatggtaacgggtggtacttttgccgaatccaataaatgcgcagtgtaaggtcatgagacgatccttttgaagatgattgtctacaccatagcgtaaagcgtgaggagactgaatgttggattctttgccggatgcggcgttgcctttttgggcctacaaaagcagatgcctcaagatcggccgtcggcgtcgcggtcagtttgttcacggcaagcgcgcagggcccggagcgtactaaatgtacgtgaggagcacgagcacttcccggggacaaaatgacaagtaagccaggctgaaacaaaacccaaaaaaaaagccagcaaaagctggccaaaataatactggaagcaatgtgagcaatgtcgtgctttcaggttctccgtaggggttcccctgaatgcaaggcaataataatcattctcattcgcagttgtctacttctttttgcaaaaaaaatgcggttgacggaattttctttctcagcgagtgtaaatacacaattaaccctgcaggagataaggaatgagtgaaatagtgatacgccacgctgaaccgaaagattacgatgccattcgtcagatccacgcccagccggaggtgtaccacaacatgctacaggttcctcatccttccctcgaaatgtggcaggcgcggctaaccgagcaagccggggttaaacaactggttgcctgcattgacgatattgtcgttggccatctttctattcaggtcacccaacgtcctcgccgcagccacgtggccgattttggcatctgcgtggatgcccggtggcacaatcgcggcattgccagcgcgctgatccgcacgatgatcgacatgtgcgacaactggctgcgcgttgaccgtattgagttaacggtgtttgttgataacgagcccgccgtggcggtgtataagaagtacggctttgaaatcgaaggcaccggtaagaaatacggcctgcgcaacggtgagtacgttgatgcgtactttatggcgcgcgtgaaataacgcttccccgccccaccctgtggggcgaaacgtcacaaaccttcacaacattccagttattgcaacctacttcccctatatcaaaacaataaccatctgaatttcatggttattaccactttaagctttatcaccgttttttccgtaattttagcaatattaatattacatttttgtttttttttggtttctgccatcactttatggtgacaatcacaacaatatactcctcccgggactaatttaaccacggtgaggtaaaaaatgaaatttgaacgccatcatagaatattgaaggaactcagtatttcgggagttgtaaaagtttcaaatctggcgaaaagtctcaaggtaacaaaggaaactattcgttcagatctcaatgaacttgccggacagggatatcttactcgctgtcatggtggtgcatttattacccttgattctcttgataacgtcgcaaaaaatgaaattgcttatgtgctggaaaaatatgaatcagcgcagaaaataaaaaaaggtctctctgccatgaaaaataatgtatgtgttattggctcgttcaatgttgatattatcagttatctaccgagattaccctcaacgggagaatcattgctggccgataaatttattttttcacccggcggtaagggatgtaatcaggcattagcagcaagctatgccgattctgatgtgcattttattactaaagtcggctcagatcattttagtgattacgccattaattttataaactcatcaaaaatccataaaagtgttatctaccagaccaaagaaacacaaacaggtacagcaaccatcatggtgaatggagataccggagataacgtcatcgctatctaccctggcgccaacatgacaatttcccctgatgaaatcaccattcagaaagaagccattgttcattcagatattgttcttgtccaactggagacgaattacgaagcgctgcagcaaacaattcgtctcgcacaaaaaaatgacataccggtcatcatcaatccagcgccgtacaatgacatggttaacaccatcattgataacattgattatattacgccaaatgaaacggaagcaggcctgctggccaatatggcggttaatgatatcgaatcagccaaatgcgcggccaaaattattcatcagaaaggcgtcaaaaataccattattacattaggtagcaaaggttcgcttgcttatgatggcacacaattcatctattccccggcatttccggcagttgtaaaaaatacggcgggagcgggtgacgctttcaatggtgccctcgcatctggtcttgcaaaaggaaagtcactggcatccgcattgtgctacgccagcgcatttgcctcacttgcggttgaaacgcctaatgcctctgatatgccggaaaacgactccgttcttcatcgtattcagggttcacattacaaacaaactatctctactcactaaatcaaggagcagactatgaacaatacgcagaaaaaactaaaggtgctctttattggagaatcctggcatattcatatgattcattcaaaaggttatgacagtttcacctccagtaaatatgaagaaggcgctacatggttactggaatgcttgaggaaaggcggcgttgatattgattacatgcctgcccacacggtacaaattgcctttccagagagtattgacgaattaaaccgttacgatgttattgttattagcgacattggtagtaataccttcctgttgcaaaacgagacattttatcagctaaaaataaaaccaaacgctctggagtccattaaagagtacgtcaaaaatggcggtggactactcatgattggtggctatctgtcgttcatgggtattgaggcaaaagccaattataagaacaccgttcttgctgaggttctgccagttattatgcttgatggcgatgaccgggtagaaaagcccgagggtatctgtgctgaggctgtctcacctgaacatcctgttgttaacgggttctcagattatccggtatttcttggatataaccaggccgtcgccagagacgatgccgatgtcgtattaacaataaataatgacccattgttagtgttcggtgaataccaacagggtaaaaccgcctgctttatgagtgactgctccccacactggggaacccagcagtttatgtcatggccgttttataccgacctgtgggtcaacacgcttcaattcatcgccagaaaataaaaaacaatggagtaacgaaagttactccttttataaaatataaggattgatgtatgaacaagaataagtactcaacccccttactgatgcttgccaccatcttagccggtatgctttccccgatgcagtctgccgttaatgggcagttaggacattggttacaagacggtaatgcttgcgcagtaatctcgtttgccagcggtctggtcgtcatgttttttattattattgcgcgcaaagaaacacgccagcaattcgcctcaatccctactctgattaaaaagagaaaaatcccgctatggaattggtttgcaggattatgcggggcgatggtcgtattttctgaaggcgcatccgccagcgcgctgggcgttgccacctttcaaacggcattaatttccgccctgctcctttccggactgctgtgcgaccgttttggcatcggtgtggaggagaagaaatattttacgccatggcgcattactggcgcattgttcgccgttatcgccaccatttttgtcgtgtcgccacagtggcactcaacctcgtttatcctgctcgctatcctcccctttttggcagggttactcgctggctggcagcctgcggggaatgcgaaagtcgccgaggcaacgggctccatgctggtgtccattacatggaacttcatcgtcggcttttgtgtcctgggcgcggcgctggcgatacgtatcgcattaggccatgtcaccatccagttacccgatacatggtggatgtatctcggtggtccgctgggtctgctgtccatcgggctaatggcgattctggtgagaggcttagggctattgatgctgggcgtagcgtcaacagcaggccaactgcttggctcagtgctaattgatgaattgatcccttcattaggcaatacggtctacctggtcaccatcatcggtacgctgttcgcgttagtcggtgcgattgtgaccaccatccctgaatacagagcatccaaaatggcgcaaagaatagaggtgtcagaatgaaaggtttcctgcaaaccgtaacaggcccggtggcgcatacggatatggggctgacgctaccgcatgaacatctgtttaacgatctgtcttcggtcgtagacgagccacattatgctttttcacagcaactggtgggaaagaaagtcagtgctgacctgcagtggggactgaaacacgacccatactgctgcgccgataacatggaccgcaaagagattgatgatgttatcttcgaaatcaataactttatgtctttgggcggcaggacgattgtcgacgccaccggatcagaatccattggacgggacgcctcagcgctgcgagaagttgccttaaaaacgggtttgaatatcgttgcgtcatccggaccttatctggagaaatttgaaagtacccggatccataaacctgttgagctgttagcctcactcattgataaagaactgaatcagggtattggcgagacggatattcgcgctggcatgatcggtgaaatcggcgtatcccccgcgtttacccaagcggagcgtaacagcctgcgggcagcgtctctggcacaatgtaacaacccccacacggcaatgaatatccatatgccggggtggctgcggctgggggatgaggtgctggatatcgtgctggaagaaatgaacgtctctccggcaaaagtctcgctggcgcattcggacccttcaggaaaagatgtcgtctatcaacgtaaaatgctcgaccgtggcgtatggcttgaatttgacatgattggtctggacatcaccttcccaaaagaaggtgtcgcgccgggcgttcaggagaccgcagatgcagtagcgaatctgattgcactgggttacgccgaccaaatcgttttaagccatgatgtttttctcaaacagatgtgggcgaaaaatggcggaaatggctgggggtttgtcccgaatgtcttcctcgcctatctggctgctcgcggagtagacaacgatactctgcgcaagctttgtattgataatccagcccgattactcacggcataatctgcaaatagcccggtgtctgacaccgggcctggaattaaaaatcagtatcccgccgttaaatcatccaccgaacgcgggtcggaagcgccatacagttcaccatccggtccaaccataatactttgggtgctgcccatcgcttctttcagcgccactttctgccctttctgttccagcaactttagcgtatcggggctgaagcccttttctacccgcagttcgtccggcaaccattgatgatggaaacgcggcgcgttggtcgcttcggcgacgttcatgccaaaatcaatgctattcactaccatttgcagcacagtagtgatgattcgactcccgccagggctgccggtcaccagccaggttttgccctctttaacgacgatagtgggcgacatcgacgacagcggacgcttcttcggaccgaccgcgttagcatcgccgcccaccaggccataaacattaggtacaccgggtttagcagaaaaatcatccatttgattattcagcagaataccggtatttcccgccacaattcctgtgccgaaggtggtgttcagggtataggtcaccgccacagcattgccgtctttatccaccaccgagaagtgggtggtctggttgctttcatacggggcgagcttgcccggttttatctggctggaaggtttggccttgttgatatcaatttgatcggccagcgttttcgcataggctttgtgggtcagcgcctgccacggcactttcacaaagtccggatcgcccagatactctgagcggtcagcgtaggcgtatttttccgcttccgccatgatttgcatggcatcggcgctgccaaagccgtacttcttcatgtcgaaattttcaagaatattaaggatctgtacgatgtgaataccgcccgaggatggcggcggcatggagaagacctgatacccgcgatagtcaccgctgattggcgtacgctcaacggctttatagttggctaaatcctctttggtcatcagaccgccgttcttctgcatttctccggctatttggtcagcaatcgcccctttataaaacgcatccgggccgttttcggcaatcatttccaggcttttcgccagattcttctggaccagcttatcgccttttttcagcggctcgccgtctttccagaaaatggctttgctgttctcatggttgaggatcacttcgctgccgtaagtttttaagtcgttggccagcgcatcgttaaccacaaaaccctcttccgccagcttcatcgccggacgcaccactttattcagcggcatcgtgccgtatttctccagcgccagcgagaaccccgccacggtacccggcgtaccggatgccagatgcgacgtcagcgactttttcgcatcggcgttaccctgatcgtcgaggaacatatcacgggtcgcgccagcaggcgccatttcacgaaaatcgatcgccgtggtagcgccatctttagtgcgcagcagcataaatcccccgccgcccagatttccggcttgcggatgcgtgacagccagcgcatagcccacggcgacggcggcatccacggcattaccgccctgctttaagatatccacgccaacctgcgtcgccattgcatccaccgaggccaccatcccttgcgtcgcccgcacaggatgaaagacatcttcttcaacaccataggagactggcggcgcgacgggaggattggccaccgcgctaaacgtccccccggccagcagagcggcgatcgccacccagcgcataaacgttggtttcatcgttgtttttctccagataaatgggtgtatgtcccgtttaatcctggcccacaacgcttaaaaaatcatcatcatggcgaaatagaggtacacttaaaaagaggcctcatcgggaggagacgacaatgaaacgcttactacttattacggctttgttaccctttgctgtattggcccagccaattaacactatgaataatcctaatcagccaggttatcagatccccagccagcagcgtatgcagacgcagatgcaaacgcagcagattcagcagcagggtatgttgaaacaacagatgcaaacgcaggcgcgcagccagcagcaaaatctacagtcgcagttgaatgccaatacgcagcgggttcagcagggacagccgggcaacggtatgctcggtcagcaaacgctgcccaatacgcagggcggaatgctcagcggcagtggaaatccggaccggatgctaaaccattcccagccaatgttgcagcaggacagcgggacgccgcagcctgacatcccgctgaaaaccatcagcccttaaaactgacggcccttaaaactgaaagtgagggccgatgtcatcaatgcgatcggtgcagatacaatccacgccccagcgcagcagctctgccgcccgctggggctgattgacggtatacaccagaatccgcagacccgcggctttaatctcttgcactcgcgtctcatcgagtaatttatggttgagatggagggaaacacagcccagacgggtcgtcagttcacgccagtcttcacgccatttatccagcagtaacccgcgcggcagttcaggtgctgccgcctgcgccgcttccagcgcctctatctcaaaggaagaaagcagcggcggcgtcatcccggcccacagttcgcgggcggccaacgccacgacgcgtcctgttagccttccgctccccgttgtcggtttgatctcaatatttgccatcatgccgtgtttacggcagcgctccgccacctgcgagagcagcggcagcggctcgcctttaaattcgccgctaaaccaaccgccagcgtccacacgcaataaatcctgccagttcaactcgcccgccacgccccaaccattgctggtgcgctccaggttatcgtcatgcagcaggaaaatttcgccgtctttcgacagcttggcatcaaactcaatcatggtgtgcccgtatcgcgcgcccacgtcaatcgccgccagagtgttttccggcgccagtttaccgccgccgcgatgggcgacaatgtggggataaggccagttactcatacacgttgtcctgtttcgccatcaaaaagatgtcgctgatgttccggcagatgcagccatagcgtactgcccgccgccgggcgctgctgatgcgccaaccgcaccaccagtttctgatcgccccagcgcccatgcgccagattatccgcgcccagaatctccagcgtatctaccgttagcggcacgccgccttccgcctgcgagcttaacgcaatatgctccggtcggatacccagcgtcatgttacgtccggcatgaccccgatagtccgcacctatcggtaacgccagaccgccaggcaattcgaaacggtcgccggaagcgctgataacgccatccaacaggttcatcgccgggctgccgataaagctcgccacgaagcgactggccggtttttcatatacctctaccggcgtgccaatctgttctgcgacgcctttattcatcaccatcacccgctgggccagcgtcatcgcctctacctgatcgtgagtaacatagagcgaggtggtacgaagacgacgatgcagatgttgtaactccagacgcatctgcacgcgcagcttggcgtcgaggttagagagcggttcgtcgaataaaaagactgccggctcgcggacgatcgcgcgccccattgccacgcgctgccgttgaccgccggaaagctcgcgtggacggcgtttaagcaggccgtccagctccagaatgcgcgccgcctcccgcacacgttcttcaatatgcgctttgctcataccacgaatttttagtccccacgccatgttctcctctacgctcatatggggatagagagcatagttctgaaataccatcgcgatgccgcgatctttgggctccatctcggtgacccgtttgcgatcaatccagatatcgccgctggtcacgcgttccagaccagccaccatccgcaacaacgttgatttgccgcagccggacggcccgaccatcacgataaattcgccatccgccacgtccagcgtcagcggttgaatgacctgggttttgccgtcccagcttttggttactgcctgtagttttaaaccagccattttatttctcactatcgaccaggccacgcacaaacgcgcgctgcatggctaacacaattacgaccggagggataagggtgagcagcattgccgccatcacctggttccattgcgtggtaccttcgccggtggcgatcatccctttgatacccgctacggcagtgccaagattcacgtcggtgataatcaacagcggccacagatactggttccagccgtagataaaggtgatgacgaataacgccgccaggttggtttttgacagcggcaacacgatgtcgcggaaaaagcgcatcggcgacgcgccgtcaatacgggccgcctccaccagttcatccggaagcgtcatgaagaactgacgaaacaggaaagtggcggtagcggacgccatcagcggtagcgtcagaccagcatagctgtcgagcattttcaggttggcgatcacttctaccgtcgggaagatacgcacttcaaccggcagcatcagggtgataaaaatcatccagaagaacaggttacgcaggggaaaacgaaaccagacgatggcgaatgcggaaagcatagataccgtgattttgcctaccgtaatgctgaacgccataatgaaactgttaagcatcatcagccagaatggcgcgctattaacaccgacgccgttgacccaaatagttttgatattctccagtaactgcgtgccgggaagcagcgtcatcggcgtctcaaacaccgcacggtcgtccagcgtcgccgcgacaaacgcgacatacagcggaaacaaaatgaccgcgatccccagaatcagcatggtatggctgaatattgtcagcccgcgacgattctctatcattggtaacgcaccttactttccacatagcggaactgcaccaccgtcagaatgatgacgaggaacatcaacactaccgactgcgcggcggacgccgagagatccaggccggtaaacccttcgcgataaatcttataaatcagcgtcgtagtggcttgtaccggcccgccggcggtcgcggcgtcgatcaccgggaaggtgtcgaaaaaggcgtacaccaggttgaccaccagcaggaagaaactgaccggcgcaataagcggcaaagaaagccggaagaaacgacgaatcggcccggcgccgtcaatggccgccgcttccaccagcgagcggggaatggattgcagcgcggcaaagaagaataaaaagttgtaactaatctgcttccagactgacgcaaataccaccaggaacatcgcctgaccgctgttttgcgcgtggttccagtcatagccgaattcgccaaggaaatgggtgattaatccccgccccgggttaaacaggaaaatccacaatacggcggcgacggcgggcgcgacggcataaggcagcagcatcagcgtctgataaaaacggctgccgcgcaccacgtaatccaccagggcggcgaaaaacagcgagaccagcaggccgctaaacgtgaccagcgcgctgaatttaatcgtcgtccagaaggcgtcgagataataactgtcgtgaaaaagcgcgacgaaattctccagcccgacaaattggctggaaaaaccaaacggatcgacgctttgcagcgaataccacagcgcttcgcccgcaggccagataaagaaaataacggtgataaccaactgcggggcaaccagtaaatacggcagccagcgcgagcggaacaccggacgggatgatgacatgaaggttcttttcctggaaggtgccggatggcggtgcatgcaccttatccggcacttatacacttaagatttgctcgctttctcaaaacgacgcagcaactgattcccgcgatccactgcggtatccaacgcctgttgtggggttttcttcccggtccagacgctttccagctcttcgtccacgatggtacgaatctgcggcatattgcccagacgcaagcctttggtgaagggtaacggcggcttattcaacatctggcgagtggcgatatccgcaccggggtttttatcgtaataaccctgctcgcgggtcagctcgtaggcggcggtggtaatcggcaggtagccggttttttgatgccattcagcagcgttttccggttttgccaggaagtcgaggaatttggcgacgccggtataggtttctttatctttaccctgcatgacccataggctggctccgccgataatggcgttttgcggcgcgcccttgatatcagcgtcgtacggcatcatacccacgccatagttaaatttggcatactggcggatattggcgagcgagccggaggacgcggttgtcatcgcgcagtcaccgttataaaacttctcggtagactcgtccttacgcccaacatagctaaaatcgcctttcttattcatctcttccagcagcgcgatatgtttcacctgctctggcttattaaactccagcaccgcatctgtaccgtcaaagccattgtttttactggcgaaggggagaccgttccaggcgctgaagttttccagttggatccagccttgccagccgctggcgtaaccgcatttcatgcctgccgctctcaatttcgcggtatagtcagccagctcctgccaggttttcggcggctgctccggatctaaaccggctttcttaaaggcgtctttgttgtagtacagtaccggcgtggagctgttaaagggctgggagagcagatgcccgcttttagcatcggtgtagtagcctgcaacggtcggtacaaactgggactcgtcaaagttaataccggcgtctttaaacacttcataaaccggcttaatggctttcgaggccatcatggtcgccgtcccaacctcataaacctgcaatattgccggcgcgttgccggtacggaatgccgcgatcccggcgctcaggttctgttcatagttccccttatagaccggaacgattttgtaatccggattggcctggttgaaacgttgcgccagtgaatcaacttctttgcctaactccccttccattgaatgccagaatggaatagtggtgacggccaacgcctgacccgtaaatgccagactcagcgccagtcctaaagctgtatgtcgtaacgatatcatcggttatctctctttttgtgccgggatgcgcgatatcacgcgttttatgttcgcgggggtaacatgacatgctcgaatgacagaaaaataacttttttattacaaaaaaaagatagtaaggcgacagagagatggcaaggcagcgaaagcgccggaaaagaaaagtgggagctacggcacggataggtacgacattattctcgggggcggcgcacatgccgtaacccaaccaggcggagcgtcgccgggattaacgtctcaggcacgtaagcgaacggcaatttgctccagcgtaagccgccctgccgccgcatcgactgtcatatcgacaaaatccggattcgcagcgagtgagatcccgttacgctttaaaaacagcagcgtaataaataaggcggtacgtttgttaccatcattgaagatatgcccacgggatatagcgagcaaatgcattgccgccagcagccacacgtcggtcaccccttcatattcgatttgcttgagtacccggtacattagcgcttccgcgcggccaggatcaggcatgcctgttacaccaggcgtaacgcggagaagcctgtcgtgaaactgaattatctcttccgctgagataagttgtagggtcatttatccgccagctccctgagctcattgccatgaaccgccataatggcagcaaactcatcatccattcgcgccgtctgataacgctcaaactcctcggcgctgatgatcactgcggacttatgcccacgacgcgtgatggtaacaggcccccccgtcaccgcactttccaggacttcggccagattttgccgcgcttcgctatagttaaccgtacgcataaacatctccccagttgtacatgtttattgtacaacaaacatgtacaaaaaaagagccatcaggctcttttgaaaaattttaccgcttgccgttaccgggggcggcgcacgcgcttcccccctggcacagtctaaccgcccagataggcgctgcgcaccgcttcgttcgccagcagtgcatcaccggtatcggatagcaccacgtggccgttttccagcacataaccgcggtcggcgagcttcagcgcctggttggcgttctgctcgacaaggaagatggtcataccctgctcgcgcaactgctcaatggtgtcgaagatctgctggatgatgatcggcgccagccccagcgacggttcatccagcagcaatagcctcggctggctcatcagcgcgcggccaatcgccagcatctgctgttcgccgccggacatggtgcccgctcgctggatacggcgctcatgcaggcgcggaaacagctcgtacacccatttgatacgctcctgaaaccgatcgcgctcggcaaaaaaaccgcccatcgccaggttctcttctaccgtcatccgcgagaagacgcgccgcccttccggcactatcgccaccgcttcacgcatgattttcgccgtctgccagtcggttatgtctttaccgtcaaacaccacccgtccgctggaggcgcgcggatcgccgcacaaggtgccaagcagcgtcgttttccccgcgccgttagcgccaatcagggtaacgatttccccctggttgatgtgcagactgacgtcgtgcagcgcctgaatcttgccgtagtgggcgctgactttttcaaacgttaacatcgttttttccatcttatgcctcacccagataagcgcggatgacgtccgggttgttgcggatctcttccggcgtgccgttcgccagcggcgtgccctggttcaccacgtaaatgcgatcggaaatgcccatcaccagcttcatatcgtgttcaatcagcaagatagtggtgttgtgatggttacgtagttcggcaatcagctcatccagctctttggtctctttcgggttaaggccagccgccggttcgtcgagcatcagaatttctggctgcgtcaccatgcagcgggcaatctccagccggcgctggtcgccgtaggccagattactggcctggcggttggcatgttccagcaggccaatacgctcaagccaggtcgccgcgcggtccagcgcttcgctttgcgcgcggcggaaagcgggcgttttcaacaggccggaaaagaggcccgttttcagttgctggtgctgcgccaccagcagattttcaatcaccgtcatttcgcgaaacaggcgcacatgctggaaagtgcgtaccacgcccatgcgggcgatctgctggcccggcaatccttccagatgccgctcgcgcaacgtgatcgtaccgcctgtcggcttataaaaaccggtcaggcagttaaacaccgtcgttttacccgcgccgttagggccaatcagcgacacaatttcccgctcacgcaattccagcgatacattgttgaccgccagcaaaccgccaaagcgcatcatcaggccgttaaccgctaataatggctgactcatgcctgctctcctttcgcctgaccacttttcagcttcaactgcggacgcgtcatcggcagcaatccctgcgggcgccagatcatcatcaacaccatcaaaccgccgagcatcaacatgctgtattcgttgaagtcgcgcatcaactcgcgcgacaccaccagcagaaccgccgccaggatcaccgcaaactgcgagcccattccgcccagcaccacaatcgccagcacgaaggcggattcggcgaaagtgaaggattccgggctgacaaagccctggcgggcggcaaacaacgtcccggcgaaaccggcaaacgcggcgctgatagtaaaagcggtcagcttgatgcgcgtcgggcttaaacctaatgagcgacaggcgatctcatcttcacgcaacgcttcccacgcccggcccagcggcatacgcagcaggcggttaatgacaaacagcgacaggaccaccagcaacagggccaccagatagaggaaaatgacccggtcggatgggtcgtacttcacgccaaagaaattgctgaaggtatcccagccgccttcgcgggtgctgcggctaaactccagaccaaacagcgtcggtttcgggatctggctgatgccgttcgggccgccggtaatttcagtgttgttgagcagcaggatacggacgatttcgccgaagccgagcgtcacaatcgccagatagtcgccgcgcagacgcagtaccgggaagccgagcaggaaaccagcagcggcggagaccagtcccgccagcggcaggcaggtccagaaacccaaaccataatagtggttgagcagcgcaaaggtataagcgccgatggcgtaaaagccgccgtagcccaataccagcagaccggacagccccaccaccacgttcagccccagaccgaggatgatataaatcatggtcatggtggcgatatcgacgctaccgcgcgacaccataaacggccatgccacggcgataaccagcagcgccatcagaaacagcttttgcttaacggtagagccatcgatcgccggcagaataaacttcggtccggagacgtgcttcaccgctttctggaacatcggacgcagcaactgaaagaaaaaaaccactgccgtaccgataaagatccactgccagcggatgtcggcggcggtatccaccaccagtttggtgccgtccagctccagttgtacgcccatgaagacgccagccagaacgaagaacatcgccgcagagaacagagccatcgcaatatgcatcggtttcatactttctctacctccggacgccccaggataccggtcggcatcaccagcagtaccagaatcagcagagcgaacgatacgacatctttatattcggtacttaaatatgcagacgagagcgcttcggcgacgcccaaaatcagaccgccgatcatcgcgcccggaatgctgccaatcccgcccagcaccgccgcggtgaacgctttcatcccggccataaaaccgatgtaggggttaattacgccatagaactgaccgagcagcacgcccgccaccgccgccattgccgcgccgataacaaacgttagcgcaatgacgcggtcggtattaatgccgagcaggctggccattttcagatcctccgcgcaggcgcggcaggcgcggcccatccgggagtagcgaatgaaaatggtgagcgccagcatagccagaaaggtgactatccagataaccgcctgcatggtggtgatggacgcggaaaagttttcgctgctgcccacaatccactggccgttaaacaggctgggtaacgccacgtcgcgcgaaccttccgtcaggctgacgtagttttgcaggaagatggacatcccgatggcggaaatcagggcaatcaggcgcttggagttgcgcacgggccggtaagcgactcgctcgatactccagccgtaggcgctggcaataataatcgcaccgataaatccagcggccaccaggagccaactggtgtctattcccatcatcattagcgcggcgatgatcataaaagagacgtagctgccgatcatatacacctcgccatgagcgaagttgatcatgccgataatgccgtacaccatcgtataaccgatagcaatcagcgcgtaggtgctccccagcgtgacgccgttaaacatctgctgcaagaaatagagaaactgctcggacataaggtaacctttttaaacccgcccggcgtgcgggcggtgggataacttatcttctggcattacttcgcgacggttgacgagccgtcggcgtgccactggaagacgccaaattcaaatcccttaagatcgcctttttcatcccatttcagcggcccaataacggtatcagccccgttagctttaagatctttcaccagatccagcggagcatggctggcgctacgcgtcattgcggtcgccagtgactggacggcggcgtaggtgatccagacgtacggaccgctgggatctttcttgtcggctttcagcgcttcgacaatcgctttattcgccgggtcctggtcataacgttttggcatcgtcaccaacatgccttccgccgcaccgcccgcaatattggacagcgacgcgttacctacgccttccggccccataaattgcgttttcaggccattagcccgcgcctggcgtagcatctgccccatttccgggtagtagccgccgtaatacacaaagtcgatattctctttttgcaagcgggcaatcagggcggagaaatctttttcgccagcggtaataccatcaaaaaagacaatattggcattgccctgcttcaggccatcctgcacggagcgcgccagtccttcgccgtattgctgtttatcgtgaatgatagcgatgcgctgcggtttcaccgtttccaggatgtatttcgcggctgttggcccctgggaggagtccaggccggcggtacgcataatgtactgatagccgcgctgggtcagctccgggttagtcgcccccggggagatcatcagaataccttcatcttcatagatatcggatgctggctgagtagaagaagaacacaagtgaccaataacgtactgaataccgtcgttaacgattttgttggccaccgccaccgcctgttttggatcgcaggcatcatcgtactctacgccgaccagcttatcgcctttaatcccgcctttcgcgttgatgtctttaatggcctggcgcgcgccgttaaattccatatcgccccattgcgctaccgggccggacatcgccccgactatggcgactttaatatcatctgccattgccccctgcgagactgctaatgcaacaatccctgcgattattgttttcgctttccgtttcatgtgcctgtatccccattcgtgatgttatatgttttgttttttgctggttaaaaagcagactgtactttttataaatggtgcgctttttactgactcattaatgagttagcgcagcatttaaagcataataagattaaaatctctatttttcagtctattaagaaaagataatattctgcttttcgctatagataaacaaaaaaaagcatgcttgtcagcataaaataacggcatattaagcggaataattcactagcattcagggaattatgctgcctgttttccattctctaatgcttcaaactgtaattatcgttgttaaaaaattaataacctggtaaatgacacaaaaaagagaaagcatctggcctgcctgtttcggtacactgatcgcatcttttgaaatcgggacaagccgtcgatgaagctgaccattcttcgtttagaacactttagcgctcaggatcagatcgatctgggcaaaatctggccggaatattccgcctcctcattaagcgtagatgaaacgcaccggatttatgccgcgcggtttaatgagcgtttgttgggcgccgtaagagtgacgctgagcggaacgcagggcgcgctggattccttacgcgtgcgtgaaatcacccgtcgccgcggcgtcgggcaatacctggtagaagaagtcatccgcgataatcccaacgtctcgtcgtggtggatggcggatgtcggtgttgaagaccgcagcgtgatggccgcgtttatgcaggcgttaggttttaccgcccagcatgacggctgggagaagcgctaaaagaaagccggatggcgctgacgcttatccggcctacatgccgggagaaaagataaaaaccacctcgcaattttccaagaatttcgcgttgcaggcaggcggcaagttatgaaatccccgggagcttacataagtaagtgaccggggttgaataacgtagccaacgcacctgcagcgcgaaaggcgccagaaaatcacttagcgtctgtcgccgtaccattcgcatgccagtcaaacacgccgaactcaaatcctttcagatcgcctttctcatcccacgacagcggtcccattacggtgtcgaccgtggcgcctttcaggtatttggcgatttccgccggatcgtcggagtggttcaggcccgcctgcaacgattgcagcgcggcgtaggtggtccacacgaatgcgccgctaggatcttgtttcttggctttgatggcatccacaatcggtttgttcgccgggacctggtcgtagttcttcggtttggtgaccagtaagccttccgctgactctccggcgatgttagacagcgacacgttcgccaccccttccggccccataaactgggttttcagccctgcggcgcgggactggcgcaaaatctgccccatttccgggtgataaccgccgtagtagacaaagtcgatattctctttcttcaggcgcgcaaccagagtggagaaatctttttcgccagcggtgatgccgtcaaagaatacgacgttaacgccgcctttcttcagaccgtcctgcaccgcgcgcgccagcccttcgccgtactgctgcttatcgtggataatcgcgatgcgctgcggttttaccttctccagaatatactttgccgccgttggcccctggtcagagtccagaccggtggtgcgcaaaaccagcttatagccgcgcgcggtcagctccggcgcggtcgccgccggggttatcatcaggatgccttcgtcttcgtagatatcagacgctggctgtgtggaagaggaacataagtgaccgataacatacttgatgccgtcgttcaccactttgttagcgacagctaccgcctgtttcgggtcgcaggcgtcgtcatatttcaccgcgacgagcttatcgcctttaataccgcctttcgcattgatatcggcaattgcctgctccgcaccggtaaattcctggtcgccatactgcgccaccggaccggacatcgcgccgacaaccgcgactttaatgtcgtcggcgaatgccatatggcttaatgacagggcgatacatcctgccaataacgttttacccttcatattcatcctgataatccccattattctggttgttacgtgtgttgtggtgttattgttcagcactttatttcgattattggctagctacccgtgctttagcagcatactctgctaaaacatacccgatttttattattttggaatagctaaatttacatccagataacagatttgtgtcggtgggggagaggaagggtccgtaggcccgataagcgaagcgccatcgggcaaacgtattgccggatggcagcgtaaacgccttatccagcctacaaaaaacaaaacccccgaattcacattcgagggttcattggcaattcgcgaagattacgcttcgatcgcagcgcgaagctttttcatggcgttcttttcaagctggcgcacacgctcagcggagacgccgtaacgatcggccagctcctgcaacgtagacttattgtcttcgtccagccagcgagcgcggataatatcctggctacgctcgtcgagcccctgcatcgcgtcggtcagtcggttggcggcctgctcttcccagttatcgtcttcaatgccgtcggcaaagttagacgatttatcctgcagatacagcaccggcgccattggctggctgtcggactcatcgtccgaagacatgtcaaacgtcatgtcctgcgccgccatacgcgactccatctcacgcacgtctttactggaaacacccagttcgcgcgccaccatttcaacctcatcctgattaaaccagcccagacgctgcttggttttacgcagattaaagaacagcttacgctgcgctttcgtggttgcaactttaacgatacgccagttacgcagcacgtattcgtgaatttctgctttaatccagtgtacggcgaaagaaaccaggcgcacgcctacttccgggttaaaacgacgtacggctttcatcaggccgatgttgccttcctggatcaaatccgcctgcggcagaccatagcccgcatagttacgagcaatatgaacaacaaagcgcaggtgagacaggatcagcgttttagctgcttccagatcgccctggtaatgcagcctttcagccaatgcccgctcctcgtcagccgataacatcggccacgcgttcgccgcccggatataagattccaggttgccaacaggggctaaagctaaattttgcatttctttggtcattcaaatcctctcaatcagtattgcctggcaccgtcagcgagcaacaaccgtgccaaagccgatgagcaacgagaatatcacccactcttttatcagacagtgattttatccacaagttcaatgtaacactgtgcataatttgcacaaatcttgtgacataaagatgacgcgcggggaagagacaacagggactctttccctgcgaacggaagcccattgcagggaaagattataccacgattttatcaatcgggagtaaagtgacgtaaatgttgcaccgtggccagccaggcggcgatccagccaatcatggaacagaccagcagcagcaacaggcactcatcgaacgataagccattgagatcaaacttcgtgccgaagacctgcgccacttcagtcaccgccgatgataaacgcatcaccaaaatttcagacaatatcagtgacagaaacgcgccggaaaaaccgagcaacgcgccgccatagaggaacggacgcaggataaagccatcggtcgcgccaatcagcttttgcacgttaatggtgtcgcgacgggcaaaaatgctcaggcgcacgctgttgccgataacgaggaagaccgccgcgaccatcagcacgccgatcatcgccgatacgcggcccaccagcccggtgagcgccgccaggcgcgcaaaccagctatcatccatgcggacttcgtcaatgccgttaatctgcgagatacggtcgcgcagcgtattaagcgaggcggtactttgaaagtccagcttggggatcaccaccgccaccgccggtagcgggttctcttccagcatatccagcgcgccgccaaaacccgaccagttgcggaattctcccagcgcgtcctcacgggacaggtagttgaccttctcaacgccctgctcggcctgaagctgcccaacaacccgcgccgccgcgtcatcatccagcgttttttgcagataaacggtgatctgcggcgacggataatactgagtcgccgcctggttgacgttcttatagaccatgtaacagacgctgggcagcgtcagggagatggcgatcaccatcaccgtcagaaacgtcgccagcggtttgcttttcagatcttgcagcgcgccgtgccaggcatagcgcacctgctcattaaagacgttcgttttacgtgagttcggtttcggcgtcggcttctggcgtcctggcgcgttgcgcccgccgcctgttccgccgcgagacttacgcagtcgatccagccgtccgccgaactgcctgatttggttaatcgcgtcgcgcctattcattggccaggcctccatgcagatgtccatcgctcaggacgagctgcctataggaacgacgggagataagtccaatatcgtgcgtagccatcagtaccgtcacccctacgcggttaaactcttcaaacagacgtaaaatcccttccgacaacgcgtcgtccaagttcccggtcggttcatccgccagcaataccgctggcttattgaccaccgcgcgggcgatgcccacgcgctgctgttcgcctccggagagttgaatcgggaagtttctcgctttgtccagtagtccaaccttatccagcgccgccgacacacgacgacggatatcatcgccgctggcgccggcaatgattaacggtatcgccacattgtcatagaccgtgcgatccatcagcagatggtgatcctggaaaatcatcccaatctggcggcgcaaaaacggcacttcgcggtttttcaagcgcgtaatatcatgcccgctgaagaagattttgccggcgctgggccgctcaatcccacagattagcttcagcagggtacttttccccgcgccggagtggccggtcagaaacgccatctcgcctggccgcatatggaatgtcactccctgcagcgcttgtctcccgccgagataggccttgctgacatgttcaaagcgaatcattgttaatcctctcgggcaaaaagtgcctcaataaaatcgtccgccttaaacggacgcaaatcctcgatacgttcgcccacgccaatgtaacggataggaatgccaaactggtcagctaccgagaaaatcaccccgcctttcgccgtaccgtccagcttggtcagggtaataccggttaagcctaccgcttcatggaacagtttggcctggcttaccgcgttctgtccggtgctggcgtcaatggtcagcataacttcatgtggcgcttcttcgtccagctttttcatgacgcgaacgatttttttcagctcttccatcaggtgcgacttgttctgcagacgccctgccgtatcggcaattaacacatccacattacgcgccttcgcggcctggatagcgtcaaaaatcaccgaggcggagtccgcgccggtatgctgggcgataaccggaatattgttacgctgtccccagacctgtagctgttcgaccgccgccgcgcggaaagtatcccccgccgccagcatcactgatttaccctgctgctcaaactggcgcgccagtttaccgatagtggtggttttacccacgccgttcacgccaaccatcagaataacaaaaggcgttttaccttcaatattaagcggttcgtctaccttcgccagaatctcgcccatctcgtctttcaacagaccatacagcgcctcggcatctttaagctgtttgcggctggcgccttccgtcagattagcgataatcttacgcgtggtttccaccccgacatcagcgatgagcaactgctcttccagctcctcgaacaaatcatcgtcgattttcttgccgcggaacagactgataaatccggaaccgagattttctttggttttcagcagactgcgtttcaggcgggcaaagaaaccttctttagtcggtttttcctgttcctgaacgatcgcttccaccggcgcgtcttcttccgccggcggaacaaccatcaccgcctcttccgccgcctgagcggccagcgcctgcgcttccagctcttcgtcggtgaatttcgccgcgttttcgccctcttcttctaccgcggcaatgacctctacggtttccgcttcggcctgccactcttccggcgagatagcctcgtctttgacctcttccggcagcggcaattcctcgcgttccactgcgatctgcggcgctgccgtctcaatggccgccgcgggctccggctctaccggctgcggtttttcgctctcctgaactttctcagtaacgtccaccacctcttccgcaaaggcttctgtttctgctttgctgtgcgcgggcgtttgcgcgtctacgtctgccgccgtttcaacagggggctcaaccggtcgttgttcctcaacaatctgctgttcttcggtctgttcctgcttctgctctttatcaccgaagcccaaccaggaaaagaagccacgttttttctgttttgccatctgcgactacacccctcgcggcgctatatacatggaagctaaaaaaatgatgaaatagtctatcacttaacttaattcacatcaccgcctggaataacttgcaacaggcggttcgagcaagagaaatgaaaaaaccgactcactctggcagcggccaaatccgcattattggcgggcaatggcgtggccgtaaattaccggttccggacagcccgggtctgcgtcccaccaccgatcgcgtgcgcgaaacgttatttaactggctggctccggtaatggtagacgcccattgtctggattgctttgccggcagcggcgcgctgggtctggaagcgctatcacgttatgcggcccaggcaacgttactggaaatggatcgcgccgtatcgcagcagttgcaaaaaaatctggcgacgctgaaagccaacaatgctcgcgtcgtcaataccaatactctgaccttcctcagccagccggggacgccgcatcacgtcgtctttgtcgacccgccgtttcgtaaagggctgctggaagagacgttacaattgctggaaacccagggatggctggccgacgacgcgctaatctacgtagaaagcgaggtggaaaacggtctgccgcccgttccggcgaactgggcattgtatcgagaaaaggtggccggacaggtcgcttatcgtctgtatcagcgcgacgcgcaaggagaaaatgatgttgattaatctgggccgcttattaatgctcttcgtgtgggcatttttgattcttaatctggtgcatcccttcccgcgcccgctcaatatcttcgtcaacgtggcgttggtgttcatggcgctgatgcacggtatgcaactggcgctgctgaaatcaacgataccgaaagcgggtccgcagatgacgacgggagagaaaatccgcattttcctgttcggcgtgtttgagctgctggtctggcagaagaagtttaagaacaaaaaataacgtttgctgccggatgacggtttattcgttatccggggtacggctaacaaacccgacgaaccgcgttcccttatagctcagcgtaccttgatcgcccaccgtcaaagcgtggtactgctgcgcttgtaaacggaacgttttttccagaccgccattgagcggcttaaaactgacctcatagcgcatactggttcccgccgggatcacttcctgctggcgagagcgtcggtcattaaccggcttctcccgtttattgctgaccacgacctgcttttgctgtaacggcgccgcctcattagcggctttttcccgccgttgctgaacgaagcggaacgacgcggcaactacgattaatgcaatgattataatgaagaaaagcggtggcttactcatactgttaacctgtcagaaaatgcggaaataagcataccctgcccgttatagtgttgtcatctgaccgtcacggcctctacactgaataatagagccgcaagcataccgtttgcgaaaaaataacgaattcaaggaattaagatgctttggtcgtttatcgctgtctgcctgtccgcatggctgtatgtggacgcctcctatcgcgggccagcctggcaacgctgggtttttaagcccgtcacgttattactgttgctgttactggcctggcaagcgccgatgtttgacgccatcagttatcttgtgttggccggactgtgcgcctcgctggtcggcgatgcgttaacgctcttaccgcgtcaacgcctgctgtacgccgtcggggcatttttcttatcgcatctgctctacaccatttactttgccagccaaatgacgttgtcgttcttctggccgctgccgctggcgttactgatagtcggcgcgttgcttatcgccgttatctggacgcgactggaggagctacgctggccggtatgtacttttatcgccatgacgctggtcatggtctggctggcgggcgaactgtggttcttccgcccaacggcgccagccctttcggcctttaccggcgcgacgctgctgttcatcggcaatatcgtctggctgggtagccattaccgccgccgtttccgggcggataacgcgattgccgccgcctgctactttgcaggacacttcctgattgttcgctcgctgtacctgtaaataatagcgcttgactctggagtcgactccagagtgtatcctccggttaatgagaaaattatcatcaaccggaggacgttatgtcgacccctgataccgatggcaaaaaagtcccgccctttacctccttcagattagccccggcaatacagaaggccgatagctgctgctgcgaagaacattgcgcgtccagcgcgcctgtttctactgccatggcaggcacgcgctatacctggaaaatctccggcatggactgcgccgcctgcgcccgaaaagtggagaatgcggtacgccaaattcgcggcgtcaaccaggcgcaagtgctgttcgccaccgaaaagttagtggtcgatgccgacgccgaccttcgcgcgcaaattgaacacgccgtacagaaggcgggttataccttgcgtagtgaagattcgcgcgacgccgcacctgaatctcgtcttaaagagaacctgccgcttattacgctgatcattatgatggcgataagctgggggctggagcaatttaaccacccgttcggccaactggcctttatcgccaccaccctggtcggtctgtatcctattgcccgccaggcgctgcgactgatgaaaagcggcagttggttcgctattgaaacgctgatgagcgtcgccgccattggcgcgctgtttattggcgcgacggcggaggcggcaatggtattgctgctgttcctcatcggcgagcgcctggaaggatgggccgccagccgcgcccgtaaaggcgtcagcgcgttaatggcgcttaaaccggaaacggcgacccgtctgcgcgacggcgtacgggaagaggtcgctattaataccctgcgaccgggcgatattatcgaagtcgccgccggggggcgtttacccgccgacggtaaactggtttccggtttcgccagctttgatgaaagcgcgctcaccggcgagtctatcccggtggagcgcgcaacgggcgacaaagtcccggcaggcgcgaccagcgttgaccgtctcgtcaccctggaggtgctatctgaacctggcgccagcgcgattgaccgtatcctgacgctgattgaagaggcggaagagcgccgtgcgcccattgagcggtttattgaccgtttcagccgcatctatacgccagtcattatggtcatcgcgctgctggtgacgcttattccgccgctgatgttcgatggcggctggcaggagtggatttataaagggctgacgctgctgctcatcggttgcccgtgcgcgctggtgatctccacgcccgcggccattacctccgggctggcggcggcggcacggcgcggcgcattgattaaaggcggcgcagcgctggagcaactgggccgtatcacgcaggtcgcctttgataaaaccggtacgttgaccattggtaaaccacgggtgacggcgattcatccggcaagcggtatcagcgaagctgaactgttggcgctggcggcagccgtagaacaaggcgctacgcacccgctggcacaggctattgtccgcgaagcgcagacacgcgatctggcgatcccgacggcggaatcgcagcgaacgctggctggcaccgggattgaagcgcaggttaacggcgaacgtattctgatttgcgcggcgggaaaacagcctgcggcagcgtttgccgggcaaattagcgaactggaaaacgccgggcagacggtggttctggtgctgcgtaacgagaccgttgttggcgtcctcgccctccaggatacgttgcgtgacgatgcgcgcgacgccatccgcgatctgcatcagttaggcgttaacggcgtgattctgactggcgataacccacgggcggcggcagcgattgccggcgagctggatctggcgtttaaagccgggctactgccggaagacaaggtgcgggcagtcaccgcccttaaccaacaagcgccgctggccatggtgggcgacggcattaacgatgcgcccgcgatgaaagccgccagtatcggaattgctatgggcagcggtactgacgtcgcgctggaaacggctgacgccgcccttactcataaccgtctgcgcgggttagcgcagatgattacgctggcgcgcgctacccacgcgaatatccggcagaacatcaccattgcgctggggctgaaagctattttcctggtgacgacgctactgggttttaccgggctatggctggcaatcctggcggatacgggagccacggtattggtgaccgccaacgcgctacgtttgctgcgtaaaaactaatcttctcccgcccggcggcgtcgtgtcgccgggttatcccgcgatattcctttctttgttcatattattcacgcgaaaattatttattttctattacttatcaaaccattaatcagaaatagcgtgatttgatgtaaggttaatttttatccaaccgatattgatcataccgtctacaaaataaggaatgttaggcactatgaaaaatatcaaagtcatcaccggcgttatcgcgacgctgggcatatttagcgccttattgctggtgacaggaatactgttttattccgccgtcagcagcgatcggctgaatttccagaatgcgagcgcactgagttaccaacaacaggaactgggcggcagttttcagacattgatcgaaacccgcgtcaccattaaccgcgtggcgatacgcatgttaaaaaatcagcgcgatcccgcctcactggacgccatgaacacgctgttaaccaacgctggcgcgtcgctcaacgaagcggaaaaacatttcaacaactacgtgaactccgaagcgatcgcgggcaaagatccggcgttggatgcccaggccgaagccagctttaagcagatgtatgacgttttgcagcagtctatccactatcttaaagccgataattacgccgcctatggcaaccttgacgcgcaaaaagcgcaggatgacatggagcaggtatatgaccagtggctctctcaaaatgcgcaattaataaaattagccagcgatcagaatcagagcagctttacccagatgcaatggacgctggggataattctacttatcgtactcatcgtgctggcgtttatctggctggggctgcaacgcgttctactccgcccgctgcaacggattatggcgcacattcaaacgatcgccgacggcgatcttacccatgagatagaggctgaaggacgcagtgaaatgggccaactggccgccggtctcaaaacgatgcagcagtcgttaatccgtaccgtcagcgcggtgcgcgataacgcagactctatctatactggcgcaggcgaaatttccgccggcagcagcgacctctcttcccgtaccgaacagcaggcctcggcgctggaggagaccgccgccagcatggaacagttaaccgccacggtacggcaaaacaccgataacgcacgacaggcgacgggtctggcgaaaaccgcatcagaaaccgcgcgtaaaggaggacgcgtggtggataacgtagtgagcaccatgaacgatatcgccgaaagctcggaaaaaattgtggacatcaccagcgtgattgacggtatcgccttccagactaatatcctggcgctgaacgccgcggtagaagccgcccgcgccggcgaacaggggcgaggattcgcggtcgtggccggagaggtacgcacgttggccagccgtagcgcgcaggccgccaaagagatcaaagtactgattgaaaactccgtgtcgcgcattgataccggctctacgcaggtacgcgaagcgggagaaaccatgaaagagatcgtcaacgccgtgacccgcgtgaccgatattatgggcgaaatcgcctctgcctccgatgagcaaagcaaaggcattgagcaggtggcgcaggcggtatcggaaatggacagcgtgacgcagcaaaacgcctcgctggtagaagaatccgcagcagcggcggcggcgctggaagatcaggctaacgaacttcgtcaggcggtcgccgcgttccgcatccagaaacagcctcgtcgggaggcgtcgccaacgacgttaagcaaaggtttaacgccacagcccgccgcagaacaggcgaactgggaaagcttctaatcagaatagtatctgccgtgcagttaatgcgctttacgcaataaataacggtacggcagaccctccgtctcttgcgccagcaaatcgtgttccataaaggtacagaaccccggaatatcacgcgtcgtcgccggatcgtcggcgataatcagcaatgtttcgccagtttgcatgttgcgcaccgttttgcgcaccatcattaccggttcagggcaacgcagccccagggcgtcaagcgtatggtcaggggaggaaaacagatcgctcatcttcgtctcaatggtagaaaaacggcgatattttacgcccatcttcgtcagtaagccaggcaggttaacgattgcgtgaaaattagccattgcaatgccagcgcaaaacagtattatgcggcggttctttattgggttccctcaccccatccaacaaaaaggtcacaatatgactccgtttacacaatcacagcgcataaaagcgttgttctggctatcgctattccatttactggtgatcatttccagtaactatctggtgcagctccccatcactatttttggtttccacacgacctggggcgcgtttagttttccttttatttttctcgccaccgatcttaccgtgcgtatttttggcgcaccgctggcgcgccgcattatcttcgccgtcatgatccctgcgctgctggtgtcatatgtggtgtcatcgctgttctatatgggcgcctggcaaggtttcgccgcgctggcgaactttaatctgtttgtcgcccgtatcgccgccgccagctttatggcctacgcgctgggacagatccttgatgtccatgtgtttaaccgcctgcgccaaaatcgtcgctggtggctggcgccgaccgcttcaacgctgtttggcaatatcagcgatacccttgcctttttcttcattgcgttctggcgaagccccgatgcctttatggccgggcactggatggaaattgcgctggtggattattgctttaaggtgctcatcagcattattttcttcctgccgatgtacggcgttctactgaatatgttgctgaaaaagctggcagataaatctgaaatttccccattaccggcaagttaaaggttcgttttccgagttgtgataagatgagcgaatgagccgttatggccgtttatcgaaaggaagaagtcaatgcgcaatttggttaaatatgccggtattggcctgctggttatggggcttgcggcctgtgataacaacgatacaaaagcgtcggcagaaagcgccgccgcggaaagccaggcatccggtcagcccatcagcctgatggatggcaaactcagtttctcgctgccggcggatatgaccgatcaaagcggtaagctgggcacccaggcgaataatatgcacgtttattctgacccgacgggccagaaagcggtgattgttatcgtcggcgataataccgatgaagcgttgccggtgctggcaaaccgcctgcttgagcaacagcgtagccgcgacccgcagcttcaggtcgtcaccaataagtctattgagctcaaaggccatacgttgcaacaactggacagcattatctccgcgaagggccagacggcgtattcttccatcgtgctgggcaaagtggataaccaattgctgacgattcaggtcacgctgcctgcggacaatcagcaaaaagcgcaaaccacggctgaaaacatcatcaatacgttggttattaagtaacctttacgacgatgatgcggcctccggcagtgcagacggaggccgtttttttaagcgccaggtcagcaatagcgccatcgctaccagcccggccgccgccagataaatcaccggcacgcccgcccaggtcatcaccagccctgccagcggcccggtaacccccaaagacatatccataaagacggtataggtcgccagcgccgcaccctggttctgcggcggcacggctttgacggccaccacgcccagcgccggaaagaccagagaaaaacccatccccgtgagtaaaacgccgatttttgccatccacggcatggctgccgttcccaccagtaacagaccaataatctccacgccaaagcagatcatggcgacattcaacccgcctaaacgattgatgccgttagggaacagcaaacgcgtgccgacaaacgcgacgctaaataacgtgagcgcaaaagcggcgccatcccagcctttagcatcataaaataaggtaataaacgtcgcgatgacgccaaaccctgccgaggccagcgccaacgccataccatacagccagacacgccccagcaccgcgcgaaacggtagcggcttgcctttgttcgccttcaccgacggacgtggaagggctaacagtaccgccaacagcgccacgcccatcaccgttagcgccagtccctgtaacccgccccaggcataacacagcacgcccagcggcgcgcccatcgccattgcgccgtaggtgacgataccgttccaggagatgacccgaccaatatgcaacgacccgacgacgccgacgccccacagtgtcgaaccggtgccggcaaaactttgcccaatccctaaaatcacgcgacccagccccagtagcaacaaactgatcatcggccaggcgctggcgatatccgccagcaggtagccgagtccgcttaaaaaacagccgcataagccaaagacaacgatttttttcggccctaatacatccgcataccgcccggcatggggacggcttaacagagtggcgaagtattgcaggctgataataagccccgcccagaacgcgctgaatcccatcgcatcatgcacatagccgggcaagacggcgagcggcaggccgatggtcaggtagctggcaaagttaaacatcacaatggagacaatacgcagattgaggcgcaatccgtttagcgccggttcagcgacgggttcgggcatgagtatcaccgcatttttacaacatgttttcttttctatcatggcgcgcggtgaaaatcagtagtgagattcagattatcggtatcagggcagccgctacacttagaaaaaaacacaacaaggaaaacttcatggcaaccgctcaacccgacaaaacgggtatgcatattctgctgaaactggcctccctggttattattctcgccgggattcatgccgcggcggatattattgtacaactcttgctggcgctctttttcgccattgttcttaatccattagtgacctggtttattcgtcggggcgtgaagcgaccgctggcgattactatcgtggtggtcgtcatgctgatcgtgcttaccgcgctggtgggtgtgcttgccgcatcgcttaatgaatttatcgctatgctgcctaaatacagcaaggagctgacgcgtaaggtcttacaccttcaggagttaatgcccttcctgaatttacatatgtctccggaacgtatgctccgcgggatggattccgataaaatcatgctcttcaccacaacattaatgaccggcgtatcgggcgcgatggcaagcattgtgctgctggtgatgaccgtggtttttatgctgtttgaggtgcgtcacgtgccttataaattacgtttcgcgctaaacaatccacaaatccatattgccggcctgcaccgcgccctgaaaggcgtctcgcattatctggcgctgaaaacgctgctcagtttatggacgggcgcgattatctggctgggactggcgttaatgggtattcagtttgcgctaatgtggggcgtactggcctttttgctcaattacgttcctaatatcggctcggtgatttccgccgttccccccatgattcaggcgctgttatttaacggtttttacgagtgcgtactggtcggcgcgctctttttggtggtccatatggtgattggcaacattatggagccacgcatgatgggccatcgtctgggaatgtccacgctggtggtatttctttcgttattggtctggggatggctattaggcccggtcgggatgctcttgtccgttcctttgaccagcgtctgcaaaatctggatggaaaccactaaaggcggcagcaaactggcgatcttactggggccaggccgaccgaaaagccgtttaccgggatgaggcgacagatgctacaatctcctcttcttcataggcaacgttggtcctgatatgtaccaggtcgttctgggaaaagtgtcaacattaagcgcaggtcaattgcccgacgcgttaatcgctcaggcgccgcagggcgttcgccgggcaagctggctggccgggcgcgtgctgctttcccgtgcgctctcgccgctaccggagatggtgtatggcgaacagggtaaaccggctttttccgccggagcgccgctgtggtttaacctcagtcatagcggcgacactattgctctgttgcttagcgacgaaggtgaagtcggctgcgatattgaagtgatccgcccgcgcgataactggcgttcgctggcaaatgcggtattcagcctcggcgaacatgctgaaatggaagcggaacgtccggagcaacaactggcggcattctggcgtatctggacgcgtaaagaagccatcgtaaaacaacgcggcggcagcgcctggcaaatcgtcagcgtggacagcacgttgccctctgccttgtcggtcagccagtgtcagctcgatacgctcagtctggcagtctgtacccccacaccgtttacgctgacgccgcagacgataacgaaagcgctatgacacattaatttttccctctggcggcggacgtgtgttacaaaatgcggagcttcccatgcgccgacgcgccataccaaaaggtttaagtcagatgcaacgtgtcaccatcaccctcgatgacgatttactggaaacgctggacagcctgagccagcgacgcggctataacaatcgctccgaagcgatccgtgatattctgcgcggcgctctggcgcaggaggccactcaggaacacggcacacagggtttcgcggtactttcatatgtttatgaacatgagaaacgggatttagccagccgcatcgtctccacccagcatcatcatcatgatttatccgtcgccacgctgcacgtccatatcaaccacgatgactgtctggagatcgccgttctgaagggcgatatgggcgacgtacagcattttgccgatgatgttatcgcccagcgcggcgtgcgccacggccacttgcagtgtttgccgaaagaagactaacgccgggggcgcttcgcttgcccggcctacgttcgcacgtctgtcgtttgtaggccggatgaggcgcagccgccatccggcaataatgtttacgccattgtgccaatcgtttttctgaagcgtaacagcgctatcaggaagaacacgccgcctatcgccagcagggtcaggaactgcggccagacgatactcaaacctgcgccgcgataaagaatagcctgggcaaggctgacaaaatgcgtcgtcggcatggtcagcataatatcctgcaccgcctgcggcatactttcgcgcggcgtggaaccgccggagagcatttgtagcggcaacagcaccagaatcattaataaccccagctgcggcatcgaacgggcgatggtgcccataaaaatcccaattgaagtggtggcgaacaggctcagcgccacgcccaacataaacaatgggatcgatccttcaatcggtacgccaagtacgcctttcaccatcagcatcaaagacaaaccggaaaccaccagcacgaccagccccatcgaccacactttcgccatcatgatctcaaagggcgtgaccggcatcactaacagatgctctaccgtgccgtgttctcgctcgcggatcagcgccgacccggtcagcactatcgccagcatggtaatgttgttgataatcgccatcacgccgccaaaccacgccgggtcgagattcgggttaaagcgcatccgaatctccagcgacaccggctgaacgttatctccccgcgcgcgcgccacaaagctgttgacctcgccgctaataatattctggatataactgttgccggtaaacgcctggctcatgcgcgtcgcatcgacgttaacctgaatatcaggctgacgtccggccagcacatcacgctggaaattcggcggaatattgaccgcaaaggtatagcgtccggcatccagtccggcatccatttccgttgccgtaatcatctccggcggcagaaaccacgggcggtaaaaactattcacaatacggttcgacaactgcgactgatccatatcggcgatggcgataggggcaagatgcaacgaaccgggcaggacggtagcagaggagtaaaccgaaatcgtaaaggcgaagacgatcagcgccagcatcgctttgtcgcccagcagactgcgcagttctttgacgccgaggttataaatattacgtaatccgcgcattacccctcctgttttttcagcagcagaatgctcagacccatcaccaccgggacggcaatcagtaacggcataaataacggccagagatcggacagatccaacgctttggaaaacgtcccgcgcgcgatcgtcagaaaatgactggtcgggtagatctcgccgatccatcttcccggtccttccagcgaagccaccggatcgatcatgccggaaaattgtgttgccggaatgagggtaataatcgacgtcccaaaaatagcggcgatttggctcttcataaacgtggagatcagcagccccagaccggtggcgatgatgacataaagcagcgccgcgagggtaagcgtgagaaagctgcctttcagcggcacgccgaacacaaagaccgacagcgcgcacagtagcaagaagttcagcatacccagcgcgatatacggcagttgtttacccagcaaaaattcgctgcgcgtcgtcggcgttacgtacagattaatcatcgaccccagctctttctcccgcaccacgctcagggcgctaagcattgacgggatcatcatgagcagcagcggaatgaccgccggaacgatagcgggcagacttttcacatccgggttatagcgatagcgcgtttcaatattgagcagcccgacctgtttaaccgggttcggctgacgacttgccgcctcctgcagccagctttggtgcatcgcctgaacgtaccccttcaccgtctcggcgcggctgggcatggcgccatccacccagacgccaatctgcgctggcgtaccgcgagcaatatcgcggccaaaattaggcgggatctcaatggcaaccgccagctctcccgaacgcatccgccggtcaagctcgtcatagctggcgagcggcggctgttcgataaaatagcgggatcccgccagattgagcgaccatgcctgactactgacggtctggtcacgatcgaggacggcaaaacgcaggttctccacgtccatactgatgccatagcccataatcagcatcagaattaccgttcccagcagcgccagcgtcgagcgtaccggatcgcggcgtagctccagcgcttcgcggcgactgtagctgaacaaacgccggaagctcaatccctgccgcgacggtttacctgacgcggcgggcgtctgggatggcggtattggggtttcaggcgccgctcccgcagcttcctgtagccaggaaataaacgccgcctccagattggccgcgccccgctgttgcaccaattcctgcggcgtaccgctggcgagcactttaccggcgtgcatcaatgacattcggtcgcaacgttccgcttcgttcataaaatgggtcgagataaaaatcgtcaccttatcctgacgcgaaagatcgaccataagctgccagaacatatccctggcgaccggatcaacgccggacgttggctcatcaagaatcagcatttccgggcgatggatcaccgctaccgccagcgataaacgctggcggataccgagcggcaacgaagcggggagcgtatcttccacctccgttagcataaagcgttcgatcatctgcgcgacgcgcgccgggatctccgctggcggaatatgaaacaggcgggcatgaagttccagattctgccgcacggtgagttcgttatagagcgaaaaagcctgcgacatatacccgacccggcgacgggtgtcgatgtcgttcgggtctaccggctggccaaatagccaggcctggccttcgctggcgggaagcagaccggtcagcattttcatggtggtcgatttgccgcaaccgtttgaaccgaggaagccaaaaatctcgccgcgcggaatacggaaattaacatggtcaaccgcgacgaacttaccgaagcgcatggtcagatctttcgcctcaatggcaatctcttcctgctcagcgtgatacggcgggatcaccaccggcttatgcgcctggcgctgcgcttctggcaacagggcgataaacgcctgttccagcgtcgcgctatgggtttttgcccgcagttgctgcgcgctgccggttgccagtatctcgcccgcattcatcgccaccagccagtcaaaacgctccgcctcttccatataggccgttgcgaccaacacgctcatattggtctggcgctggcggatactgtcgattaagtcccagaactgagcgcgggagagcgggtccacgccggtggtaggctcatcaagaatcagcaattccgggtcataaatcagagcacagcacaaccccagcttttgtttcatcccaccggacagcttcccggcaggacggtcacgaaacggcgccaggccggtgctgttcagcagctcggtaatacgcgcttcgcgttcagctttgtcatgaccaaagagacgagcgaaaaaatcgacgttctcataaaccgataacgtgtgataaaggtttttccccagcccctgcggcatccaggcgatgcgcggacagacgtcgcggcgatgtttcgcatcgcgcatatcgccgcccaggacgataacgttcccttgctcaatcacccgcgcgccagaaatcagcgacagcaggctcgacttacccaccccgtccggaccaatcagcccgaccatactacgggcgggaatgtccagcgtgatattgttcagcgcgaccgtttttccgtaatgctggctcaccccctcaagctgcgccacgggaggaacaggcaccagcgtcagcgacgtcattgcgacagcctcacgcttagagcgtcaggccagggcacgcgctcatccagacgaacccaggccattcccggcaaaccggttttgacatattccagatgctgtcgcagcagctctggcggaatacgcgctttgacgcggaacatcagcttcagccgttcatcgtgggtttccacggttttgggcgtgaactgcgccacgctggcgacaaaactgatcgtcgccggaatacgcagatccggcgcggcgtccagcaccagtcgcgcttcgccgccgatcttcaacaacccagcctgttcggtcggcaggaaaaatgtcatataaacgtcgctgagatcgaccatgttcaacacccggccgccagccgataacacttcgcccggctccgcaacgcggtactgcacgcgtccatcgcgcggcgcttttaattcgctgtcgtcgatgtcggcgacaatacgccgctcggtcgcctgcgccgcttccacgcgcgtttgcgcctggataatactggtacgcgccgcctcaatcgccgcttttgccgcagatacctgcgctttggcggtctccagggcggcgcgcgcgctttccgccgccgcgcgatcgtcatctaactgttgtacagataccgcgccacgctgcgacagcgaacgggaacgcacgtgacgtttagagacggagtccagctcagcttcccgctgtttgacgaccgactgcgcggcgcgcatttcactctggcgttgctccagcaaggcacgggcggcggcaaccgcgctttcggcctctttaatctgcgcaatcgcctccagccgctgctcctgcagcacgcgggtatccattttcgccagcacctcgccctgacgaacgaactgcccttccgaaacgaggatggtatcaatacgcccggcaatcttagtggcaatatccacttcggtggcttcaattctgccgttgctggcggcaaacccctccggtattcccgcagggcgcagcatccaccaggctatcgcggccaccgccacaagaatccccgctccccaccacaccagatgacgcttcattttgtccataatcgacccgccgtaatccctgttgtctaaccatgcgtgtcacaaagtccgccgggcgtgcgctcagcgggggtttccattcgggataagaatgaaaaaagaaaaggggccagacgacgaacagacgccgatgaagcgctcgccgtcaaagggagtgaatgatgtaggtacccggaaaagagggagtaatgttgtcatcatcagcgttcctggccgtaaatgaaacacgcatactcataactgctataaatcgatactaacacctctgtccgggatgtctattcgcttattgtttgtaatggtacttagcgttttgccgccaaatcctgcgcacaggcccaggcgctcgaccaggcccactggaagttatagccgcccaaccagccggtgacgtccatcacttcgccaataaaatagagacccggcacgcggcgcgcttccatagtccgcgatgatagttcgtttgtatccacgccgcccagcgtcacttccgctgtccgatagccttcggtgccgttaggctgcacttgccaggccgtaagcgtgtcaaccaacgcctgctggtcacgaacgttcaactgcctgagcgatacatccgggatctgccccaactgttgtaaacactccaccaaccgtttcggcagatgcatcgccagcgtgttcttcagactctggttcgggtgcgcgttacgctgttcattgagaacgtcttccagcgagagatccggcaataagttaatgctcactaactcgcccggttgccagtagctggaaatctgtaaaacggcggggccggacagcccacgatgggtaaaaagtaggttttcccgaaataccgtgccattgcgggcggtaatcacgcagggcacagagacgccagacagcgtctggagctgttctaacagcggcttatgtagcgtaaagggcaccagcccggcgcgcgtcggcaacactctgagaccaaactgttcggcgattttatagccaaacggcgatgcgccaagccccggcatcgacaggccgccgctggcaatcaccagcttttgcgtagtcaccgtctcgccgttcaacgccagtatgaaacccgactcatcacgctcgacgctcaatacctcgctacgcaggcgcatcgttacgccgcctttgtcgcactcggcaaccagcatatcgacaatgcgttgggcggaatcatcgcaaaaaagctgtcccagcgttttctcatgccaggctatcccatacctgtcgaccagatcgataaaatcccactgggtatagcgggctaacgctgatttacaaaaatgggggttctggctcaaatacgcagcaggctcaacataaagattagtaaagttgcagcgcccaccgccggacatgaggattttacgtcctggcttcttgccattatcgatgagcagcacgcggctacccgcctgtcctgcctgcgcggcgcaaaacatgcccgctgcgccagcgcctataataacggcatcaaacctttccacgtcgccttcctctctcaaattcgggcgggaattgtaaagtttcctcagtggtcgcaccagcgcgaaaagcgcctgaaaatggtatttatctgaaatatataagataattctttagtgatatcaaacaaagcacgaagtacatcaaaaaaagtctatatttcactttgcccgcgccgccaaagtcactgataatgcgccgcgttcatgtcctcaaaatggcgtaacgtcctatgctacatttgtttgctggcctggatttacataccgggcttttattattgcttgctctggcttttgtgctgttctacgaagcgattaacggcttccatgacacagccaatgcagtcgcaaccgtgatttacacccgtgcgatgcgttcgcagctggcggttgtcatggcggcggtgtttaacttttttggcgttttgctggggggtctcagcgtggcgtatgccattgtgcatatgctaccgacggatctcctgctcaacatgggttccgcgcacggcctcgctatggtcttttccatgttgctggcggcgattatctggaacctcggtacctggtatttcgggttgccggcgtccagttcccacacgctgattggcgccattatcggcatcggtttaaccaatgcgatgatgaccggcacgtcagtggtggatgcgcttaacatcccgaaagttatcaatattttcggttcactcattatctcccctattgtcggtctggtattcgccggcggtctgattttcttgctgcgccgctactggagcggtactaagaaacgcgcccgtatccacctgacgccagccgaacgtgaaaagaaagacggcaagaaaaagccgccgttctggacgcgtatcgcgctgatcctctccgctatcggcgtggcgttttcgcatggcgcgaacgatggtcagaaaggcattggcctggtcatgctggtgctgattggcgtcgcgcctgcgggtttcgtggtcaatatgaatgcctccagctacgaaatcacccgtacgcgcgatgctatcaacaatgtcgaaacgtactttgagcagcgtcctgacctgctgaaagccgtcaccggcgttgaccaactgattccctctccggaaccgggcgcgactgaaccgactgaattccactgccatccggctaacaccattaacgcgcttaaccgtgcgaaagggatgctggcaaacgtggaaagctacgacaagttaagcgttgaacagcgtagtcagttgcgtcgcattatgctgtgcatttccgacacgaccgacaaagtcgtgaaattgcctggcgtaagcagcgatgaccagcgcctgctgaaaaagctgaagaccgatatgttaagcaccattgagtatgcgccagtgtggatcattatggcagtggcgttggcgctgggtattggtacgatgatcggctggcgtcgcgtggcgaccactatcggcgagaaaattggtaaaaaaggcatgacgtatgcgcagggaatgtcggcgcagatgacggcggcagtctctatcggtcttgccagctacaccggtatgccagtttctaccactcacgtactctcctcttcagtggcgggaaccatggtcgttgatggcggcgggttgcagcgtaaaaccgtgaccagcattctgatggcctgggtatttacgttaccggcggcgattattctttccggcgtgctgtactggctttccctgaagattatttaagccaaatgggccggatagcgctgtcgctaatccggcctgtcaggatgaaacgacacaggcctgataggccgctataagcggcgtcatccggaggcttatctaatacgagcgggtcaggaaactggcccgctttttttattcagtgccaaatcatgagcgcaatcaagctcaccaccaccaaaccgcataacgcgctggtcagcagaaactggcggcgcacgcgttcacaacggcgaataaattcttcatcatgatgatcgcgatagcgctgagcgtagatataccataccaggcgcacctgtttgttgggctgaccatgcgtggtaaagaagccgccgccatcgacatattgatagagcaaaggatcgcaaccacgaagtaccactaacagtgcgcgtagcgatgagaaatagcgcgccatattaacaatgcaaacgacacataaagcccagaatagtgagacggtgcttatcatatctcctccccggcgacccgcccacggagttcctctccgggactaccgctccccgataccctgccagacaatcagtgaaagagtactacgaaagccgtccatattagcgctccgcattcgaacggctcttatacacattgtaggagatcagttaatttttttaccagaaggttaatcactatcaatgcaattccctagaaattttgtttaactaactggcaagcaaggcagattgacggattatcctggtcgctataatgtaaggatagttatggtaaacggctgagctagccccgcgcatagagttcgcaggacgcgggtgacgcggcggcataagaaacgccagtagctcaatggtcatcgacaacttatggaaggagtaacactatggcttataaacacattcttatcgcagttgatctctccccggaaagtaaagttctggttgaaaaagcggtctctatggcgcgcccctacaacgcgaaaatctccctcatccacgttgatgtgaactattctgacctgtacaccggtctgattgacgtcaatctgggcgatatgcagaaacgtatctccgaagaaacccaccacgcgctgaccgagctgtctaccaacgctggctaccctatcactgaaaccctgagcggtagcggcgatttgggccaggtgctggttgatgccatcaagaaatacgatatggatctggtcgtttgcggtcatcaccaggacttctggagcaaactgatgtcttctgcgcgccagctgatcaacaccgttcacgttgacatgctgattgtgccgctgcgcgacgaagaagagtaatacttgccgtgccggctggcggctaagaccgcgtctggtctatagtcaatcaggttggcctgaaccatcaggcaaattccggctatcaacaacaacgcccgcttatgtgggcgttttgtttatccccccttcttcgcagtactcagtacatcattccatcacaccaaacataattagtgtgatccactaattagtttgcgtatcatttgtataataacctattgatcaggctaataaccgcagtctatatcagggtaagtcttttcggcgcgttttgatatacgcgctcatacgtttcgggatggcattaaaaggcgaaggaatatgaatacaactgcacctacgggcttgctgcagcaacctcgtccattcttcatgatcttttttgtagaattatgggaacgatttggctattacggcgtccagggcatcctggcggtctttttcgttaaacaattgggtttttctcaggaacaggcctttattacctttggcgcttttgcagcactggtttatggcctgatctccatcggcggctatgttggcgaccatctgttagggactaaacgcaccctggtcctgggcgcaattgtgctggcgattggctattttatgaccggcatgtcgctattaaatcccgatctgatttttatcgcactgggtacgattgccgtgggcaacgggttatttaaagccaatcccgccagcctgctctctaaatgctatcagcctaaagatccccggctggatggcgctttcaccctgttttatatgtcgattaacatcggttctttgttatcgctatcgctggcgccggtgattgccgataaatttggctatgcggtgacctataatctgtgcggcgctggtttaattgttgcgcttctggtgtacttcgcctgccgtggcatggtgaaaaatatcggttctgaaccggatcataaaccgctacgttttcgcaatttgctgctggtactactcggcaccgtcgtcatgattttcctctgcgcctggctgatgcacaacgttaagattgccaatctggtgctcatcgtcctttctatcgtcgtcactattttcttctttcgcgaagcgtttcgtctggataaaaccggccgcaataaaatgttcgtggcgtttattctgatgattgaagccgtgctgttttacattctgtatgcgcagatgcctacctcgctgaacttctttgcgattaataacgtgcatcatgaaattcttggattcgccattaacccggtgagttttcaggcgctgaacccattctgggtggtcgtcgccagtccggtactggcagcgatttacacccggctgggtagcaaaggcaaagatctgactatgccgatgaagtttacgctcggcatgttcctctgcgcgctgggttttctgaccgccgccgccgggatgtggtttgccgatgcgcaaggattgacgtcgccgtggtttatcgtgctggtgtatctgttccagagtctgggcgagttgttgattagcgcgctggggctggcaatggtcgccgctctggtgccgcagcatctgatgggctttattctgggaatgtggttcctgacccaggccgccgccttcctgctcggcggttatgtggcgaccttcactgccgtaccggaaaacatcaccgatccgttgcagacgctgcccatttataccggcgtctttagcaaaattggtctggtaacgctggcggtcaccgtggtgatggccattatggtgccgtggttaaaccgaatgattaatacgccaggtaccgaacagtaatactcagtgccggatgcggcttacgccttatccagcctacaaataattgagaatcgtaggcccgataagcgtagctccatcgggcaatccgttactccgtcagaggggttccggcataaatatcaaaccgatgccctttggtgacgatggcgttgggcgtcgcgacatccgccagcggcggcgcataatcgggacgtttaaccaccacgcgtttggtcgccaactgacgcgccggttccagcagtccgtcggcgtctaaatccggccccaccaacgactgaaacacccgcatctctttcttcaccagcgcgcttttctgccggtgaggaaacatcggatcgaggtagaccacctgcgggcgcggcgtgatatcggtcaacgccgtcaggctggaagcatgaatcaactgcaaacgctcctgaagccagccgccaatgtccgcatcggcgtagccgcgcgtcagaccgtcatcgagcagcgcggcaaccaccgggttacgctccagcatccgcacgcggcaaccgacggacgccagcacaaacgcatcgcgccccagtccggccgtggcatcaaccacatccggcaggtaatcgcctttgataccgacggctttcgccaccgcttcgccgcgcccgccgccgaacttgcgccggtgcgccatcgcgccgccgacaaaatcgacgaaaataccgccgagcttcggttcgtcgcgcttgcgcagctccagatgttgcggcgtcatcaccagcgccatcgggttgtcttcgtcatgctccagtccccagcgggcagccagaacagataaggcgccgtctgtggcgcccgtttcatccattaagcagatttgcacgtaaaatcagcctttaatcccgtaatgctccagcatcgcgtccagttgtggttcacggccacggaagcgtttaaagagttccatcggctcttcagaaccaccgcgagtcaggatgttatcaaggaacgactgaccggtctcacggttgaaaatgccttcctcctcaaagcgggaataagcgtccgccgccagtacgtcggcccacagatagctgtagtagcctgccgcatagccgccagcaaagatatggctgaacgcatgtggaaagcgaccccatgtcggtgacggcaccacggcgacctgttttttaatttcaaagagcgtctcaagaattttcgctccttgctgtggattaaattccgcatgcagacggaaatcaaacagaccgaactccagctgacgcagaataaacagcgccgcctgatagtttttcgccgccagcattttatccagcagttccttcggcagcggttcgccggtctcatagtggccggagataaacgccagcgcttccggctcccagcaccagttttccataaactgacttggcagttcgaccgcgtcccacggcacgccgctgataccggagaccccggcggtctcaatgcgggtcagcatatgatgcaggccatgaccaaactcgtggaacagggtgatcacttcgtcatgggtaaacagagcgggtttaccgttcaccggacggttgaaattacaggtcagataagcgaccggcttttgcaatgtgccgtccgctttacgcatctggccgacacagtcgtccatccacgccccgccgcgtttgtgttcgcgcgcgtacaggtcaaggtagaagctgccgcgcagctcgttattttcgtcatacagttcaaagaaacgcacttccgggtgccagacatcaacgtcagtacgctctttggcagtgatgccgtaaatacgtttcaccacttcaaacaggccattcacggctttgttttccgggaagtacggacgtagctgctcatcgctgatgctgtacaggtgctgtttttgcttttcactgtagtacgcgatatcccacggttgcagctcctcaacgccaaattcggctttggcgaaggcgcgcagctgggccagctctttttccccctgcggacgggcgcgtttcgccaaatcggttaagaaatcgagcacctgctgcggattttccgccattttggtggccagcgattcatgggcataattttcgaagcccagcagttgcgccagttcatggcgcagcgcaagaatttcttccatcaccgggctgttatcccacttaccggcgttcggcccctgatcggaggcgcgagtggaataggcgcgatacatctcttcgcgcaacgcctggttgtcgcagtaggtcatgaccggcagatagctcgggatatccagggtcagcaggtaaccttcctgctctttggcttccgcctgggctttagctgccgccagagcgctttccggcattcccgccagctcggcttcatcggtgatgagcttcgtccagcccatagtggcatcgagcacattattgctgtactggttgcccagctcagacaggcgagtggcgatttcgccgtaacgctgctgtttctctttcggcaggccgatgccggacagttcaaaatcacgcagcgcgttatcaaccgctttcttctgcgcggtattcagagtggcgtaatgatcgccgtcgcgcaggtcgcggtacgcgttgtacaacccttcatgctggccaacccaggtgctgtattccgacagcagcggcagcgtctgttcgtaggcttcacgcagctccggactatttttcaccgagtttaagtggctaattggcgagaaaatacgccccagaacatcgtcggcttccgccaacggctggcagaggttttcccagctatacggcgcgccatgcgccacaacgccttctaccgccgcccggcaatcggccaacgctttggtgaccgcaggcaccacatgctccggtttaattgcagaaaaaggcggcagtgaaaaagacgttagtaatggattggtcatatgcgcagtcctgtagaagaaggtgagtggagcgcgcttttggcgctctcgcgatgagatctagaatgggggatagtaaggggaatttcaatgatggacagcgtacagacgtgggtatcgctgcaataagccgcccctttaacatcatcccggcttacgttttataagccgggtgacaacgtcagcgcgtttttctcgccatctcgtaagcagcggacagatccagacgctgccagaactgttgatcctcggtctcgcccgacaacggatatcctgccggtaacgccgtctcttccattaacgcctgacgctgcgctggcgacaggttcggcagcgctgtctgtagcagaacatcggcgccttttggtattttcaacggctgatgctcgcctttctgttgcggcaggttataagtcatggtgaagcggtagaaggtatgcatggccggatcgcggtacggatcgtcttttccggtcgatgccgcgcattcgacaatcgtcgtaccgcactctttcaccagcgcctcacgcagttgagcgcgagcttcgttgaataacgtacggtaatacggatcgttaagataatgcgcgacattacgctgcgcgaccatccgcgcgcccatcacatccagcggatagtgtacgccaaggaccaggcgagaatagccataacgcgcgccacgaatcaccagcgcatcaaagcgttccgggatcatttccgccatcaacagcgcatccgtataaccggtattcgtgtgtccgctggggaaagcaccgccacctgcggtataaggatgaccatcttttaccaccacatcatccggcgtcaaatggatagtattacccggcacctggtaaggacgcgggtaatgaaaatattttttcgccgcgccggtgctgacttccgaggctttaatcaacgccgccgctttgcccaactcacctttatcataagcggcgagaaatgcccgccccagccgcggccccattgcgtcgctcaggaaatagagatactccacgctttccgcatccgccagcgcctggtgacgggtattaacatcggcatcgtgattaatcgccgtcaccgtcgccagattgtctttcaatactgcttccggcaatgtattgaaggcggaaagtagggtaatccccatctgttgattctcagtagtatgaaaatcataaccgctagcctgtaaccaggcattatccgcctggatggaattctgtcgcatctgagccagggcgtcgcgagtcaacgcggcggtatcgccttgtaatgccttacgcaactgtgtcagccattgagcctcaaggtcattaaaggcgacgctcgccgagtcgggcgtcacgcttttcgctatcgactccgcctgggacaggggaatatctttcgccagtgccggcatcgccagcgccagagatgacgccagtacagtaatgtgtagtttcattatggttcctttcattaaaaataacgccaggtcaaaactactaccttgcccacaggcgatgctggcctgcgcagttgacggtttgatgatacgaacacgtcttgcaatactttcacaacgcgcgaaacaacatggcggtactggggtaatctctacggatctgcggtaaactatcggctaacttgtttacttcccggaatatctgcatccatgctcagttatcgtcacagctttcacgctggcaaccacgccgacgtccttaaacataccgttcagagcctgatcatcgagtcgctaaaagagaaagaaaaaccgtttctctatctggacacgcacgcgggcgcggggcgttatcagttgggcagcgaacatgctgaacgtaccggagagtatctggaaggcatcgcccgtatctggcagcaggacgatctgcccgccgaactggaaccgtatattagcgtcgtaaaacatttcaaccgcagcgggcagttacgctactatccgggctctccgttaatcgcccgccagttgctgcgtgagcaggacagtctgcaactcacggaattgcatcccagcgacttcccactgttgcgcgcggagtttcaaaaagacaaccgcgcccgcgtggaacgcgctgacggctatcagcaactgaaagccaaattgccgccggtttcccgccgcggtctgatcctcattgacccgccttatgaaatgaaaaccgactaccaggcggtagtcagcggcatcagcgagggttataaacgtttcgccaccgggacatacgcgctatggtatccggtggtgctccgccagcaaattaagcgcatgattcatgagctggaggccaccggcatccgtaaaatcctgcaaattgagctggcgatccgcccggacagcgatcagcgcgggatgacggcgtccggtatgatcgtggttaacccgccgtggaaactggagcagcagatgaacaacgtgctaccgtggctgcacagcaggttggcgccaaacggtcacggacacacttcggtaagctggatcgtgccggagtaatcacagccatcggtggaacctttcaccttcaggtatacaatcgcgaatattttggcgggtagcgcagaatctatccgtccgacaacgaacataaaggagcggtcatgaccaaacactatgattacatcgctatcggcggcggcagcggcggtatcgcctcgattaaccgcgccgctatgtacggccagaaatgcgcgctcatcgaagccaaagagctgggcggcacctgtgttaacgtgggctgcgtgccgaagaaagtgatgtggcatgccgcgcagattcgtgaagcgattcatctgtatggcccggactacggttttgacaccacgattaatcagttcgactggagcaagctgattgccagccgtaccgcgtatattgaccgcatccatacttcatacgacaacgtgctgggcaaaaataacgtggatgtgattaaaggctttgcccgctttgtcgatgccaaaaccattgaagtgaacggcgaaaccatcaccgccgaccatattttgatcgctaccggcggccgtccgagccatcctgagattccaggcgtggaatacggcattgattccgacggtttctttgcgctatctgccttgccggagcgcgtcgcggtggtaggcgcaggttatatcgccgttgaactggctggcgttatcaacgcgctgggggcgaaaacgcatctgtttgtccgtaaacatgcgccgctgcgcagttttgacccgatgattagcgaaacgctggttgaggtgatgaacgccgaaggcccgcaactgcatactcacgccgtgccgaaagcggtggtgaaaaacgccgacggcagtctgactctggaactggaagatggccgcagtgaaaccgttgattgcctgatctgggccattggtcgcgaaccgtcgaccgacaatattaatctggcggcagcgggcgtgaaaaccaatgaaaaaggttacatcattgtcgataaattccagaataccaacgttgaaggcatttacgccgttggcgacaatactggcgcggtagaactaacgccagtcgccgtcgccgccggtcgccgtctctccgagcgcctgtttaacaacaagccggaagagcatctggactacagcaacatcccgaccgtggtctttagccatccgcctatcggcaccgtcgggttaagcgagccgcaggcgcgcgagcagtacggcgacgagcaggtgaaagtctataaatcatcgtttaccgctatgtataccgcggtaacgacacaccgccagccgtgccgtatgaagctggtctgcgtcgggccggaagaaaaaattgtgggtatccacggtatcggcttcggcatggatgaaatgttgcagggcttcgcagtggcgctgaagatgggcgctaccaagaaagacttcgataataccgtcgctattcacccgaccgcatcggaagagtttgtgaccatgcgttaatatcttgtgcgcccatcttcaagggtgggcgcacaagcctgcatgattaatacgtactgaaataactctggatcagttccggattacgcgtctgagttaatgccgtcatcagcaagactcgcgccttcgccgggttgagcgagtcagacaccagccctggctgccctttatccaacggtacgacgccgtttccggtgcgggaagcgcgcaccacgataatcccggctttctccgcttttttaatccccgcgtcgctgcgtaccgagaccgaacctgcgccggttccggcataaataataccgtccgcgtgatgggcgatcgccgcatcatacatatattccgggtcgtcctgatagccgtaaataatcaccacattgggtaattttttgatattacgtacgtcaaaaacagatcgcagggtatgaattttttccacccgcgtttcgaactgtggctgaccattaacgatgacccccagatagccctcttccggcgctttaaaggtatccagagtcgtggcattagttttcgtcacaaagcgcgccgaaccaatacgatcgtttaaaaccaccatcacaccgcgtcccttcgcattcgggtcagcagccaccgtgaccgcttccagcaggttcattgcgccatcggcgctgattgccgacgcgggccgcattgcagcggtaaacaccaccggtttgtcgcttttcacggtcaaattaagaaagtaggcggtttcatcgagcgtgtcagtgccatgagtaataaccacaccgtcaacatcgtcccgcgccaataacgcattcaccttctgtgaaagtttcaggatgatatcgctggtcatattttcgctaccaatattcgccacctgctcgccgtcaacgcgagcgatattattcatttccggcacggcatttattaatgtttgcacgccaagttcaccagatttatatccggcggtttgcgtattattggctgccgtcccggcgatagtaccacctgtcgcgagaataacaatatgcggtagtgacgttgtgctaaatacacagtggctgatgagcagcaacacggtggccatgaaaactctaattttcattttcttcctctgaattaaaaataataagtggcgtgtgctataaaaacatgaataacaatcaggccagaaccatttttcctattaacagcccgacaatgaccgagacaatcacgttaactaatcccggacgcataaaactatggttaagcacatatttgccaatacgcgtcgtaccggtatcgtcaaacgccagcgccgccagacactgccccgccaccggaataaagaaatagccgttaacggcaggccaggagccgattaatgcataagcgggcaaccctaacgccagccccagcggcaacagaattaacgtcgttgccgcctggctgctgaccatagcggacacaaaaaacatcataatggcgataagccaggtatgctgttgcaatagagtttgcacttctgccttaatcaacgcgatatgaccattcacgaacgtctcactcatccaggccaggccgaaggcgcagacaatcgccagcgcgcccgcccgaaataccgtaccgctgataatttgatcgacctgcggtcggcataacaacacaatcaggcaggcaaaagagagcatcgtaatctggatagcggcggacatcgaaagcggttgtagccctttcgctgtttccaccatgggccgcagcgccggaatcagtcctaacagaacgataacgatcgcactggtcagaaataacgccaccgacaatttggcgcgcgaagtgaccaccgtatttttactttctttctgcgcaggtttaattaacccttcagcaagccgacgttgatattccggatcgtcttttaactcttttcctttattaaaggtcgctattgcccccatcgctacgccgattaacgtggcgggcacgcaaatcatcataatggttgaaatagagacgcccaacggcgccattaaaccaatcatcgccgccatggcggcagatataggactggcggtgatcgcctgttgcgatgcgataacggaaatagataaaggacgttccggtcgaatacctgaatcccgtgcgacttcagaaataaccggtagcaagctataaacgacatgccccgttcctgacataaaagtgaagatataacagataaacggcgctaataacgtaatgtaacgcgggtggcgacgcagaattttttccgccagtttgaccagtaaatccagcccgccggaggcctgtaaagaagcggccgccaggacaacagaaagaataatcagaataacatcaatcggtggcgtagaaggcgtcaggccaaaaataaaaaccatcacgccgacgcctaacccgccgaccatccctaaaaatacgccgccgatcctggcgcctatcatcagggccacaaggataaaacataattccgtccaaaacatacttcctcctgggttatctggagtgagtgtcgctttacattgagggacgtaacctattgtgcaaacggtttaccaaaaccaaatgcgccgtaatgagataacacctgcgccgccgatttcccgccctgccgcatggcgcgtaacacgctttctttatcgggttccgccatacccgattgcaaaatggaaagcaaaaaaccggttaagaaggcgtcgcctgcgcccagcgtatcgacaggttcgatataagcaggttgccactccagataatccgcgccggaaaaataataaactttttcatgcccgcaggtggcaataatatgccgacagccataacgataaagtttattgagttttactttgatttcatctggcgataacccgctacaggagataaatccgtaatctacccacgggcataccttttcaaaatagtcgtctgtaccgcgcccggaaaaatcaaaagagagtaagacggtttgttgtttaattttctccagttccgattccaggtggccgttaatactggaatggactaaggtaaattgtgatatatagcgaagatcgtcgtcagacagactaaaaggatgttcccgcaatacgccgtttttgttgctggcgacaaattgccgatcgccatgcgagagacggatacaggcatacccattttcgccggtataatggcggctgtgagagatgtctatctgtagctggtgtaatacatcctgtacgtgctgcgcggcgtcgtcattgccaaacgcccccataaacgcgctggggatgtctgctaatttcgcatagacagcaaaatttaatgcattaccgccggggtacatgatgccggaatgcaggtatttatcgacaacgttgtcgccaatacccaatacgctgatgctcatcattattccttgtttgtctttacaataaaaagcgtccctgcttttttatccatcctgatgtaattaatattccactttccacatatagcggcgcgtcgttaacggatgctgacgcgcctcagctaacgcccgattgtaaacgggataaacgttattaaagagagagtggttaaagtaatcaataaccgtggttttaatggtcgatagccccagttctttcgcatcgacaacttcaatccggcggccatattttttcaggaagtttaacgcgcgttcatccaccgcccgcgtattgccctcggaaaactggaagaagaaaggcgtattcgcatcggtaatttcaaacggcccgtggaaaaactcaccgctatgaatacaggcggaatgtatccattgcatttccataaagatgcagatgctctgtaggtaggctgcgccatagcccgcgccgctggcgacggtataaatgactttatcgtctttatattcctgcgcgaacgcctgcgcacgctccgctacctgctcgcaagcgcgccagacgatacggttgattttgctgacgccatcctgaaaatcgtcgtagtgcgcatacccttccgtctgctggagcagttcgaccgcactcagcaggcctttcatcgttttctctccggcaatatctttaccgtcgccaaacgtgtacgtttccacatagtcgcaatgcgccaccaacggtgaatccattatccaggttaaaccaatgaccggcgcgccgtgctgacgggcgatttcagccgctttaattgtctctggcgtattacctttgtgggaggcgacaaccacaacggcattttctcccagcgctaccggcgggttgttaataaattctccgctgttatacagaccgacagtcaacgctttcgcttctttttctaaaaatgctttcgccggatagaacgccgcataagaaccgccgcacgccacgtaatagacgtgtttaacgcctcctttctctgcctggctggtcacaatattgctaactgtctctttcatacccatcatgctttcctctggttccatcaatgatacaggcgaggattcgccataaatgactcataatgtattattatttttatatgacatttaaagacatttgatcaagatggaaaccaaaaaaaatcgggatccgcgatctggatcccgattcagcctgctcttcgttagcgtaatgctgacatcatacggtaaaccgtattttatcgccgacaatcaactgttgcgaaacgcaggagagttctcctttgttatcaatcatttcactttttatcaggatcagcggataaccctcgttgacgccaagataatgggcgacttcaaagctggcataaaccagttcgatcatcttacgggagtgggtaaaccataaatggtatttctcgcgtaagcattcatacaaagagtgattattaagatcttcgtccagcaaaaacgcaaaacgtgggggaagatgtacggtttccagcgataccgccacatcgtcggcatagcggatacgttcaatgacgaccgctttttcgccatcgttcatattcagtaacgcttttgtctcatcgtctaccgattcaaaaacggatttgatggtgcgtgaccccgggcgacgtccctgggactggcataactcgctgaaactcatgatgccggtcatgctgcgctgaaatttctcaccagagacaaaggtgcctttgccggagacacgggtcagcaaattttcacgcgtcagcgcatccagcgccttacggaccgtgaccctgctcacctgccagcgcacgctcagttcattttccgtcgggatctgctggcctggtttatactctccacgcgcaatagcctcttttaaggcggcttcaagctgcttataaagcggtttggcgcttttactgtcgggttgctcgatcatttgtatccatttgtattatcatgatgccatagcttgtattataactatttacgttacctttgcttgtgaatccacgccatgcggtgacgtagtgataccgctatgaaacgaatgttctgattttaggtctggggcgggcgtcatgaaaataggattttcgcaatactattcagtaagttatgaagtgtttttcttgagagacaaattgcaaaatgtgatctatcgcacactttgccactcaggtatcgaagcgaatgtctacgcttaatagacagccgggcaacacccgtatcttttacgacgcaagccggaggtccttgtcattatgctcaaccagaaattaaaccccacgccttctgaagatctgactattgatgtcgatctgctttatgaaacagacccgtgcgagttaaagctggatgaaatgatcgaggcggaaccggagccggagatgatcgaggggcttcccgcctctgacgccctgacccctgccgatcggtatctcgaactgttcgagcatgtacagtcaacaaaactgtttccagacagtaaaacgttcccggactgcgcgccgaagatggacccgcttgatatcctgatccgctaccgtaaggtcagacgccaccgtgattttgacttacgccgcttcgtcgagaaccatttctggctaccggaaaccttatccagcgagtatgtctctaatcccgaaaactcgctcaaagaacatattgaccagctttggccgatactgacgcgcgaaccgcaggatcatattccgtggtcttcgctgctggcgctgccgcaatcctatatcgtgccgggaggccgttttagcgaaacctattattgggactcttattttaccatgctgggtctggcggaaagcgggcgcgaagacttacttaaatgtatggcggataatttcgcctggatgattgaaaactatggccatattcccaacggcaaccggacctattatctgagccgttcgcagccgccggtttttgccctgatggttgaactgttcgaagaagatggcgtgcgcggcgcgcggcgttatctcgaccatctcaaaatggaatacgccttctggatggacggcgccgaatcgctggcgctcaaccaggcttatcgccacgttgtgcggatgccggacggttccctgctgaaccgctactgggacgatcgcgacacgccgcgcgacgagtcgtggctggaagatgtcgaaactgcaaaacactccggtcgtccgcccaatgaagtctaccgggatttgcgcgccggggcggcgtccggctgggactattcttcacgctggctacgcgatgcgggccggcttgccagcatacgtacgacccagtttatccctatcgatttgaacgcttttctgtataaactggagagcgctatcgccaatatttcagcactgaaaggcgaacgtgacaccgaggcgctatttcgccagaaagccagcgatcgacgcgccgccgtgaaccattatctgtgggatgatgaaaacggctgttatcgggactatgactggcgacgcgaagaaatggcgctcttttccgccgccagtatcgtgccgctgtatgtcggtatggcgaaccacgagcaggccgaccgtctggcaaatgtggtacgcagccgtctgttaacgcccggcgggattatggcgaccgaatacgaaaccggcgaacagtgggataaaccgaacggctgggcaccgctgcaatggatggcgattcagggcttcaaacggtatggcgacgatatgctgggcgatgaaatcgcccataactggttaaaaacagtgaaccatttttatcaggagcaccataaactgatcgagaaataccatatttccggcggtacgccccgcgaaggcggcgggggcgagtatccgctacaggacgggttcggctggaccaatggcgtggtgcgccgcctgattggcctttacggagagccttaacctgctccggcctcagtgaatcgcatcataaatggctgactgaattttcagccattttttattgtctgcgctgggccgggcctgagcgcgcaatcgggcctgctccgtatcgtgctgctggcgcgtcacaacagccggaacggtgcaaaacgtttgcaaataggttttatgcatcgcggtcagcggcgcgccgctcgacatgtcatgacttaacgttgtgataaatcgtcggcagggtttgacctcatccatcagcgcgggataacgcaacaacagttgcagcacctcggtatgtcctgccgcaaacgcctgctccgtccacgcgagctgccagttcattccgccctggaggaacagcgccgtcacccgcgtatcattgcgctctatcgccgcccgcatggtaaacgcatcccaggtaatccccatatgattgagcgtttcccgcgcggaaggcgcctcgcgcggcggttcatcctgcgccattgcgggagcttgcccgttatcggagcctggcgacgacgaactaaatagccagaacgcgcccgccagtatcgccagcgtcatgacgccaaccgcgccccacaaagcgccggaaataagttgctcacgctcttcaggcgtacgcggaggccgcttacgcggtggttctatgctctcgctaatctcatgcttatctcccccggcctgccgatctttaagccgcgcggtttcccagaactggcgcaattcacgttcatccgccagcagaaacgaagcgggattcacgcgggtacgtttttcggcataggcgcgctggatgggccgaacgatttgctgatactgaacgtttagcagcataagctgcgctgaggtaagcggctgcctggcgataacctcgtttcgcgcaaggcggcaatcatccagaaacatacgcagagtggtgcgcgactcggcgaacagcgttaacgctgaggcatcattaaaaattctgacgtaatgacgggcaaacaattttttatcgaccaccataagcgccagttcgctgaacaacatgccctccagcgcatgttgatcttctccctgttttaaccactggcgcaaacggtccgggccgaaatgttgcttgaggtagtgattcagcgacgcccgatccggccatgcgcgcgcaataagcgcttttaacgtcagttctatcgcccgaagctgacgctgcgcctcaagatgcgcctcctggtcgggttcttccagctcagtttgatacgtcagtagcggctgctgctgacgtagatgctccagcgaggtgacaaaacgcaacgcggcaaggagttgattttcgctcacctcttgcccgctgtcatactggggaacatgctgctgaaggtgacgcagttgcagcataaactggctcaactgcgcgtcatttatccgcaattttttcgccaccgcgccccaaccgcccaggttaagacgcgcctgctcaagttgttccatgaaccaccggggctcttttccctctgtggtatgaatacccagcagcagcaggatttctattgatgcctggcggataatccccaggctatgttcaaaaggcgcgcgtgtcgcctgcgaagcgctattcgtcattatcttccctaaaaagacgatcccgcgacgagatcttcgttttcttttaattatgttttttcatagatataacagatttagccacatttcagtgacttaatcttaatgattgcaaatttataagaagatcggttactaaccaaaaacatcagtttttcattctgtcaacgcggcgtgacgctgaacggcatagaccttttccctgcctgcgtttggccgtctgaccgctagccacgcgtgcagcacactttataatcgcgctttttatgagaaagatgccatgccgcacatttcatctcgctttagctccgcctgcatcgcgtttattaaacagtggcagggtctgtcgctggaaaagtatcgcgatcggcagggtaactgggtgattggttacgggcatatgttgacgccggatgagacgctgacgttcattacgcccgaccaggcggaggcattcttgctggatgacctcaatagctgcgatattctgctacagaattgcttgccggaacttaacgatcggtttcaacgcgaaacgcttattgcgctgatgttcagcatcggacatcagcgttttttatcattaatcaatacgggtgatatttcacagccagaaataagcggactgcgaatttaacgtcgttaattcgattcatttaacatcatggcggcctgggtacgattttttacatccagccgccggtaaagcgactccagatgcgctttaaccgtcccggtactaatatttaacgcccgcccaatttgtttatttgattctcctgcggcaagcatctgtaaaatttcccgctggcgggcgcttaacgcttttatatcacgggactccagctccgttgaatttaaccaatcccccggtaaaaacatcatcccgcgagcgacagcattgagcgcaaggacaaaggtttcagcatcagaatcgcgtggcaccacggcctgaacgttaaattgcatgacttcatgcagccacttttgactgccatccatcgccgtgataataatcttcacctccggaaattgctgcgcggttctttgtaacacctcgcggcaaaactcagcatccaggccgctatccagcatgaccagcgcatccggcgcgctttctattttttgccagagttcttctgcctgaccgacactctggatacttattcctggaatgtgctgctgcaaactgattttcattccatgaataaatattgactgcctgtcaaacatgattacctgcattacttttctccacctgggtaagataatagtctcaagatgaggaagggtattacccgtagggtaaaataagaagtcgccatttggtataggccattttaccgatagtcattggttgaggaagggaaaggttatgaatatttacagcttcaacatcgggattacagaattcgctaaaattagccttttaaagtaaggaatatcttattagcgcgaacagctaaggctaatttgaatattaatttaatgaagagtacgcctggcgcgtcacaaaggaaatatctgcttttcgcctgatgtgttacaaaaaataaagtagcacattttgttaaaaaatagccaatccgcctgaaaaccgcgacgatgggtcaatgacaataccgtgtatgtacatgcatttctctgccccactgcacccgctgttatcggcgtgttttaccgccctcgccccgtttatcggctttttggcgctaaaatgcctggccggaaggcgataaatccgccgcgcaacgcgatcagacgtattcgtcacgcgagcaatgattgcgaaagggcttattaggtgctagaaaatcaataaaaccagccgcttcagcgtcactgtttcaataagaacaataatagagcctgatgatggataaaatatatgcaatgaaattgtttgtacgcgtggcggaacgggaaagtttttcccgtgcagcagaggatatcggccttcccaaaggcagcgtctcacggcaaatacaagcgttagaacatcaactgggcatccgcctgctccaccgcaccacccggcgggtacagcttactcaggacggaatggtttactacgaacgggcaaaagatctgttgagtaacctggatgaactggagggtcttttccagcctgatcccgccagtatcagtggcaaaatacgggtagatataccgccatgtctcgcaaacagcctcatcatgccgcgcctgcccacttttttgcatcagtatcccggcattgcgctggaactttgtagtagcgatcgacaggtcgatttactacgggaagatttcgactgcgtggtgcgcacagagccgctacatgcgccagggatactgacgcgcccacttggcaaactgaggagggtgaactgcgccagcccacaatacctggcacgctttgggtatccagaaaaccttgacgatctcgcctcacatgcgatggtgcattattcattgaccccgggagtctcttcaccgggttttgcctttgaaactccccacggtatgcagtgggtaaaaaccggcggaatgctaacggtaaacagtacagagacctggcatacggcctgtctggcaggattaggaatcattcagacgccgcgcattgctgtacgggaggcgttacgcgccggaacgctcattgaaattttaccgcaatatcgcgccgctccactgccggtgacgctgcattatccccatcgccgtaatctttcccgccgggtacacctgtttatggtatggctgacggaaaccattaaagaggccgcagagtagccgcattttcagcatccaccggggagaagctatactgacatattctattaatgatgaaggactaccgacctgatgacgcaggaaaatgacgtaaaacgccctattcaggaactggagcacgacccgatacaaaaaatagaaacgcagccgcatgacgccccggaaaaaaacgaaaaggcaaatcaggcgttgcattccgtcaccaccctgatgcaaaaaattcagcgtcaaccaatggtggcccacctcattcgcgcgaccgaacgttttaacgatcgactgggtaatcagtttggcgcggctatcacctacttttcgtttctgtcgatgatcccgataatgatggtgtcctttgccgcggcaggttttatcctcgcctcgcaccctaatctactggaagatattttcagcaagatattgatgaatgtgagcgatcctacgctggcgtccacgcttaaaaatacgattaatacggcggttcaacagcgtaccacggtagggctggtcggactgggtatcgcgctctattccggcgttaactggatgggcaacctgcgggaagcgattcgcgcccagtcacgggacgtctgggagcgcaagccgcaggatcaggagaaaatctggctcaaatatctgcgcgattttatctcgctgattggattattaatcgctttaatcattacgctgtccattacttccatcgccggttccgcccagcagatgatcatctccgccttgtatctcgacagcatcgaatggttaaaaccggcctggcatttgatcggtctggccatctctatttttgccaactatctgcttttcttctggattttctggcgactgcctcgccatcgtccccgtaaaaaagcgttgattcgcgggacatttattgccgctatcggttttgaggtgattaaaatcattatgacttatacgctgccgtcactggtgaaatcgccttccggcgcggcgtttggctccgtactcggtctgatggccttcttctacttttttgcccgcctgacgttattctgcgcggcctggatagccaccgccgaatacaaggacgacccgcgaatgccgggtaaaacgcaacgctagtctgcggcttgctgccgaatggcacgcacggcgtcgtcattcggcctactgatgtgtagacccaggccgggcaagcaaagcgtacccggcggtacaatcaggcacgtccttccgcctcatctcattgtttcagcatataaatccagtaattaacttttatttaaccagaaaccagttttatccaccaattctaaaattatgtgaagcatttcatagacgcaaaatggctggcttaaacattatcccctttttgcgctttttttgaccatttttagcttttgttacacattgaaatataacttttgctgtgcgtaatatggctattcgttcgctaaaaataagaaaatagtatgcaagcaaccgccacaacactcgaccatgagcaggaacatgttccggtaaactcacgcaataaagtcgttattgcctcgcttatcggcaccgcgattgagttcttcgacttctatatttacgccaccgcagcggtgatcgtgttcccccttatcttcttcccccagggcgatcccactgcggcaacgctacaatcgctcgccaccttcgctatcgcgtttgtggcgcgtccgattggctctgcgctattcggtcacttcggcgaccgggtaggccgcaaagtcacgctggtggcttcgctgctgacgatggggatctccacggtcattatcggtctgttaccgggctacgcgacgataggtattttcgcgccgctgctgctggcgctggcgcgtttcggtcagggactggggctgggcggcgaatggggcggcgcagcgttattagcgacggagaatgcgccgccgcgcaaacgcgcgctgtatggctccttcccgcagttgggcgcgccgatcggcttcttttttgccaatggcaccttcctgttgctctcctggctgctgaccgacgagcagtttatgagctggggctggcgcgtgccgtttatcttctcggcggtgctggtgattatcggcctgtatgtgcgcgtgtcgctgcatgaaacgccggtgtttgcgaaagtcgccgcagcgaaaaaacaggtaaaaataccgctgggcacgttgctgacgaagcatgtccgcgtaaccgttctcggcacgtttattatgctggcgacctacacgctgttctatatcatgaccgtctattccatgacttacagcacggccgccgcgccggtggggcttggcttgccgcgcaatgaaatactgtggatgctgatgatggcggtgattggtttcggcgtgatggtgcccatcgccggcctgctggcggacgcatttggccgtcggaaaagcatggtcatcattaccacgctcatcattctcttcgcgttgttcgcctttaccccgctgctgggttcaggcaatccagcgctggtattcgtgttcctgttgttaggcctgagcctgatggggctgaccttcggcccaatgggagcgctgctgccggagctatttccgacggaagtgcgctataccggcgcatcgttttcctacaatgtctcatcgattctgggcgcttccgtcgcgccgtatattgccgcatggctgcaaagccactacgggctggcggcggtaggggtttacctggcgtcaatggcggcgctgacgctgattgcactgctgttaacccatgagacgcgtcatcaggcgttgtaatagggcgccggatggcatcatccggcgctacgtttcacgttactgcttcatctgcgttaaaatcgtccggcactgattggcttcgccttcagagggcgaaattagcgccaatagcgcggcggcgggcgttaccaacgtcgccagcgctgccgcaaccgcgccgcgcgcaatcagcgggccgggcttgacgcccgcctgcggatttttaaatgtcccgcgcacgtacagcggcgatcgcagcgtaataatacgaatccccttactttccggatcaatggttaaatcgagctgttcagaggcgaagctcgccgtaccggtcacgttaatcaacgcattttctgtatcaaaagcaaaaatttgcggtcgcgccacgccgttcgtaatattgagattcgccgccgcgcagttaacccgcacttcgtcatcgccaaaaatctgcccgacaatatagttgccgacgttcagccccacgatttccatcaggttgcggctaatcaatccatcattcatcaataacttcagattgccgttactgttgccaagcagcgcggcgaccgagttgcccgtcccgcgaatatccgcatcgccgttcagctcgcccagcgttttctgcatcagctccacatccggcatcagttctttaagcttcagccgacgcgcctgtatatccgcccgcccctgcattggctttttatccccttccagatggatgttggagacaatactgccgcctgccagaccaaacttcagcggctgtagacgtaagtcggcgtttttcaggatgatatgggtcgaaagatcgctaatcggtagactgccgccatgttcaatacgtcggcctttaaaccggacatcggcgtccataacgtcccatttgtcggtttcaaagcgatcgtaaggcaacactttatccgccggctgaacattcttctcgcctttgcgctgttcagaccgtttcgactgctcagcgtctttcccggaatccacgccaatcagcggcccaagatcggccaggcgtaactggcgcgattcgacatcgccttccagtttagggcgcggtttaccggtggtataagtgagggagccgtggatatcactgtcgccaatgcgcccgttaaaaccgcgataatcaaatactgatgacttttcggcgtcaattttcgccaccaatcgcccatcggtctcaaacggcggcgtatccggcagcagcacgccggttaaatcatataaatcgcccagtgaatcgccagagaatttaagccgcagatcgacgccgcccattttcatcggttcgttcaccacgccgctaaaagccacccgcgtattaccagagcggaaatcggcctgcacaggaaaaggcgtactttcgctgcgtagcgccagcataccgcctattttccccgtaccggtcaacggttccccgttataacgcccctgcgccttcaggccgaagacatagtcgcccacggtggatttgtctgctttgcctttcgttcccgtcacttcgctgaacggcaacggtttgcctaacggatcgatcagaatagtgatatccgccttgctgaccttatcatcgatcgcgattcgcccctggtcgaagagaatattatccagccggaaggaccaggcggaaggtttagcattggggtccgtattcttgtcttgcgcgaggttaaaggtccagttattggttttctcggacagacgaataagacgcgcgtcgggtttcaccagtttgatccacggcagccagacggttttggtcaggagcgccagtggggcaagcgtcgcctcaacgcgtggcagatgcaccatcgtgacttccggaatatctggcggattgccgagaatgacgtcttccgcgtgaacatgcggccacggtacccagcttcgccagccggtctcctgtttttggcgttcccacaccacgcctaaatcgccgcgaatagcgaaaggccggttcaattcggtagagactttctggttgatggtcggtttgaggcggttccagtcaaatgttgcgatcaacaaaatcactatggcgatcaacaacaagaaagtccctgtgatggcggcggttattttgcctgctttagtcatgtgttatttcctcacttcttcccttgcctgtcctaaagatagttcagccagacgaaaaaggaggatgaccgcgcctcgtaataccacgtattacgggaacagtctggcgttacagggtcagaatcacctcttcgagcgatatcagcggcacgggtcgagaaagaaaatagccctgggcggcaaaggcgggcgaacgctgcacatcacgccactcttccagcgtctccacgccctcgacaataacgccgcggcagtagcggttcatcagttgcagcagcagagtgaacaggttgcgtccctccggggactgacgcagcatgacgaacagctcgcgcgccactttaatgtagtcataacgcacttcgctcagcgctgaaaaattggccataccggtaccaaaatcatccagccacagcgggccgaactcacacatcgaggcgaaagaggagtctttcggcaaacgaatatgttccaccagttcgaaacgcagccagggtaagcgctccatcgctgccagaatgtccggctgtcgtcgcatggcaatcagcgtagggccgtcgacattgaccgatgccaataagtgatggcgagtgaaaaaatccgctttttgttcgagctgatgaagttgttctttcactacgtcaatgcggtgtcgaaccgctaactccgcgaaataacgatccggggcaatacgtctggaagggttatcaggatgggtgacgacagtgagaagttcaaccgccatcagacggccatccgtctggtatatcggctggtaagtataggcacgctcgcattgcagccaatagcgccgttcctgcaaattctctatacctgcatcaggaacgcgtagctgctggataacctgctttatcatctcagttgtcctgttaatgggagtgtgactgtccggactcgtcaaaggttatcggcgttcaggcagagaactttaccctcggtccctggcaaaataaaaacagcccccgaaacttgtcaaaaatacgcacttgctcaaaaaaataatggaccgatgttttaatattattgaccactaaacatccacagcgcacactaacgctaatttttacagatcaggttcacgactatgtctaaaaagattgccgtgattggcgaatgcatgattgagctgtcgcagaaaggcgctgatgttcagcgcggcttcggcggcgacacgctgaatacctccgtttatattgcccgtcaggtcgattctgccgctctggccgttcactatgtgacggcgctgggtaccgacagtttcagccaacagatgctggaggcgtggcagcatgaaaatgtggatacctcgctaacgcagcggatggaaaatcgcctgccaggcctctattacatcgaaaccgatgacactggcgagcgtaccttctactactggcgtaacgaagcggcagcgaaattctggctggagagcgagcagtcagcggctatctgcgagacgctggcgaccttcgattatctctacctgagcggcattagcctcgcgattttaagcccgaccagccgtgataagctgctgtctttattgcgtgaatgccgggccaacggcgggaaagtcatttttgataataactatcgcccgcgtttatggacaagtcgcgaagaaacgcagcaggtctatcaaaagatgctggaatgtactgatatcgccttcctgacactggacgatgaagacgcgctatggggtcagcaaccagtggaagaggtcattgcccgcacccatgcggcaggcgtgcaggaagtggtggtaaaacgcggggcggactcttgcctggtctcgattcagggcgaggcgctcattgacgttccggcagtgaaactgccgaaagagaaagtgatagacaccactgccgcaggcgactccttcagcgccggttatctggccgttcgtttgacgggcggcagcgcgacggatgccgcgaagcgcggacacctgacggccagcacggtgattcagtaccgtggggccattattccgcacgacgcgatgccgcagtaagtcattcgctcttgcccggtggcgctgcgcttaccgggccgacaggcggcagcttactgtgccgccggtgtctccgtcacttccggatgcgcctcatctgcttcaacagcggcggcagtagtcgggaccatgatttcatcccacgtcgcctttaacgccttcatattaaattccggctcgccttgcggttgcagcaaaattaatgccatctcctgcgatagctgctgacgtaaattctgattgagcatatcaacggtcaggctgttgaggaaattctggcgcagcttctgatactgctccggcgcgatatccaccacttgattctgcagcgagcgcatacgctgtccagtcaaaatgtcagtatcggtacgcgcgtaggtcgcgaacagcttttgcaattcgagatttttctgcgccaccagcgcagtaaactcctcttccgacaaacctttgtcgcgtactttcgccagttcattcgccaccaggctcaaattggtattgagcttatcattaggtgattcaatgttgatggcgcactgcgcgcgcagaaacagaacccggcagtcaaaccccagaccaatatctttcgcgttatttttagtaagctcttgctggatatgccagaacagcgcttcgcgcgccagatccgcctgccagtagcgcaacagcgccgccgactcgcgaatcggttgccacggcgtatcccacataatggagagacgatcctggcgcaccgcatcggtcataatgctcactgattccgcccgcagcggcgaaagcgtcggcaccggggcgggcgtttcgcgtttacctttcagcgtaccgaacgttttattgatctgctcggcgacggagcgcgcatcaatgttgccgacaacaatcagcgtcatggcatccggggtgtaccatttttcatagaaagcctgaattttggctgcgtctaccggctgctttaacggttccgcgggatcgtgccccaataacgccgaccctttcagccgataacgccaccagccctctttagtatctgctggccacgtcgcaaccatatcttcgctgcttaacgcatgattcaccgtctctggcgtaatggttaatttaccggagacgttagccagataggtcagcgcttctttcagcagatcgttacggttattgggtaaactgaggttatagagcgtggaatcataagaaacaataacgggcggcatgggacgtttcggatcaaacccttgctgccataaagaacgtgcctgtgcggcatccagaccaccgctttgcgtcagcgcgatacggggaatcgcatggctgaacccgctctgttgcgtactttcggtgagcgaaccggtattaacctggagacgaacttcaatacgatcgctggggcgctgaggcgtagccaacacttgccactgtaacccattagccagcgtcccctgttgccatgccggatcgggctggagcgcatctgcctgcacatagccggcagaggccaacatcaacagactgcccgctaagagtcgaatttttgtgccctgcatgtgaacccctgatcaacaatcctggtaataaaaagacagccccggcagggatgcctgaatatgacgtaaaaacacttcgtgttagaccgcgagaacctaaaaatgtcacggaagaagtgaaataatccctaagcatcatgctgtatgctttgggcgcaggggtcaattatgcgcaaacacccgcagtcctggaagggactacgggcataagtggcgagattaggaggaaatttcgtgcgttttgccatccggcgcacgattattaagcacatcgtccagcttttggtgatctaactctttcacccatttggcaaccaccaccgtcgccacgccgttacccaccaggttagtcagcgcgcgcgcttcggacataaagcggtcgataccgaggattaacgccagtcccgcaaccggtaaatggcctacggcggagatagtggccgccagcacaataaagccgcttccggtcacgcccgcggcgccttttgacgatagcagcagcacgaccagcagcgttatctggtggaagatatccatatggctgttggtcgcctgggcgataaacaccgccgccatcgtcaggtagatagaggtgccatcgaggttgaacgaataccccgtcgggatcaccagccctacaaccgacttacggcaccccagtttttccatcttatcgagcatacgcggcaacgctgactcggaagaggaggtgccgagcacaatgagtaattcttcccggatatagcgaataaatttaaaaatgctaaagcccgttacccgtgcaatcgtccccagcaccaccaccacgaagagaatacaggtgatatagaagcagataatgagctgccccagttgcaccagagaaccgacgccgtatttaccgatggtgaaggccatcgcgccgaatgcgccaatcggcgccaggcgcatgatcatattgatgatgccgaaaatgacctgcgaaaaactctcaatcacattgaaaatgagctggcctttgctgcccaaacggtgcagcgcaaaaccaaacaacaccgcaaacagtaagacctgcagaatgttgccgctggcaaacgcgccgatcacgctacccggtatgacatccatcaggaaggcaataatgccctgctccttggcttgtgcggcataaacggccaccgcctgcgcatccagcgttgccggatcgacgttcatcccggcgccaggctgcacaacgttgacgatgataagaccgataatcagcgcaatcgtactgacaatttcaaagtaaagcagcgcgaccgcgccggtacggcccaccgctttcatgctttccatgcctgcgatgcccgtcacgacagtacagaaaatgacaggagcgatgatcatcttaatgagcttaacgaacgcgtcgccaagcggtttcatttgtgcgcccagttcaggatagtaatggccaaggagaataccaatggcgattgctgtcaggacctgaaaataaagacttttgaacagagaggttttcatagggtgtccttgaagtaaaaaccacaggtcttgtaaggttatgagtaacctgcggccttaaaataacacccacacaacatgacagaaatgcgccaggatcataattgaaacaaaaatgttaaaaagtttgagctggctcgcacaagcgcgaccttttttaacttttgtaatcaggattttcgtgcgacagataccgttcttcaaagatatccgcgggaacgggccgagcaaacaggaagccttgcgcgacgttgactcccgcctgttccagccacgcgcgttgcgcctcgttctccacgccctcggcaatcaattgtaaattaagactgcgggccatcaggataatcgccgtcaccatactgtgatcatccggtaacccatcgacaaacattttatcaattttaaggatatcgaccggtagcgacttcatatgctgtaactggcgcagccccgcgtaacccatgccaaaatcatccagtgcgatacgcacgccagcattacgtaacggacgtaagatagcgacggcagcgtgtggatcgtcgatacggcggctttcagtgacctcaagaatcagcgtacccggttgaatacgatagcggtttaacaattccagcagatccgacaccatgccagggtgcatgagctgtaacgcggaaagattgacggagagcggcaatgtcacgccgcgctcctgccaggcggcaagctggcgacaggactcttccagcacccaatagcccaccgtgaccatcaggccgcaggattcaatgcgctcaatcagcccctccggtaattcccagctaccgtccggctgctgcatacgtaacaaggcttcggcgcttaatacgttgccgctgcgcatttcgacctgcggctgcagccaaatggcaaactgatggttatccagcgcggtaaggatatcgctctcttcggtaaggcgctgttgagcggcctccatctgcgccgggtcaaagaactggatctgatttttaccttttcggcgcgcggtaaacgcggcggagacggcgcgaccatagagcgcttcggcggtcagatcgccataatacatcgcaatgccaatactgcagcttgggcgcagttgaataccctggatgggcagtcgttcattaatgatagtgagtatttgctgacctaatgtgatggcgtgccacggctctttaacgccgtgggcgataatggcaaagtcatacccgctgacctgcgtaagcaccatgcgcggcgccagcaccgacttcagcttctcaaccagcgtcagtaatagaatctcccgctgcgtttcttgcagcacgcctgccgtgtcacgcaacgtttcgcacgtcacgatgataagcgcggtggtctgttggcgggtgataacctgttccagcaatgccattaaaaaggctttattgggcagctcggaaaccggaaaacgcatcgcgttgtccgtttgctcctcgcgttgacgctgcataagctgctggttgaggttatagctgcgcaccagcatcccaatttcatcatcctgatgcagacgcggcaacgccagctgatgtccgatcagctcctgctgcggaatgtcgttcagctcgcgggcgattttgcgcagcggatgcacaatcaggcggtttacgcaccaggcgatggccaccgtcaggatcagcgataaaagtaagtaaatggtcactaacgtagagagcgcgctcatgacgaacttgtacatacggtacgaatccgcctgcaatacaaggtaggccagcggttgcggattggcaggacgctccaacgaataaaccggcaaagaaatttgtaccggcagttcgaagagacgcgtcaccataaccgggacggggcgttcaggaatgaagcgcttacgcaacgcctggaactgattcggcaataccacatcggcgcgactcaccacgcccgcaggtttaatactttccagaatggtttccgcgccggggagatccgcttttaaaatcgcggaagaaagaggttcccgaacagatcgcgcgatgctttccagttgcgtagccgtgttgtagcggttctgctgtaccagatggaacaacaaaacggtgcaaaagacaaaaacaaacatcatgacaacggccgcaaccattgccatctgtttaattgttaacgagcggctgacgcgcaaattgactctccctggatatcccggactgccgcctgagtatacccgattgcagcggcattaagagaggctgtatctgaaaaggacttttctgaataacggttaatgatagcgtctgatggcgctgcgcttctcaggcctacgacgcctgtcaattcgtaggcctgacgcaatgattaccagtcagcgtaaggcaccagaggctgcggcggtaaatccatatccccctgccagcccgccgcggaataacgaacatacagcagcagatgactgggggtatagtctttcgcctgctgaatatcgacagccgtacccacaaaccagttggcagtgacccggcgttcaatgagcgcccgcgcggtatagccaaatccctggctgctgccgccgccgttggtctggtcacgcgcatcctcctgataatctgccgggatcaaattcatcagcggataacgcggcatggtacggttgcgggagtgcgaccaggataccgagccgcctaactcccacgaccagttttccgtacgctgccgccacatcaccggcaccgcaaacgacaggtattcctgcgggctataataaccgccctgacccagtgaataaccgctcagatctttgtcgtaatgccagatcatgttattcagcccgacggtaacacggcggttattctcgttaatcaccttatagtaataaccggtcatccagcgcacgcgccagttatcttctacatttttaccgctcaactggtcgccgctgagcgacgcccagacaccgtttgcttcgcctttatcatagctgagactgacgccgccgccgttggcccgcacgccgccccatttggtgccggtattgctgctggcatccttttgcccgccaaacgccagcagcgagctggagatcgggcgacgatgcgcgttcagggtataacccaacggcccgatatcgtcgctatagctgacgccgccaaccacatcaacgacattaaagcccatcggcgtcgtgccgatatcccagcgccaggtctcattctgccagccgaccgccacgctcgcgcccgtatcggcctggctacgatgtccgctgcatttctccagcgtacaggtaccccagttattatcgtattttccatccgcatccgtagagaagcggccaacatccatattcaccatatcagtacgaaagaacgcccgtccgtccgaccagggcgcatccacctgaagcatcgtggtatgcgccttcagatcggagtaaccgccagtcccgctcgacccccaataatcgtgcgccaacgtgacattgagatcctgctgacggtacaactccgccgcatcgctacgcacgccgcgttttagccagtcgtctttttcatcattgcgcgtcaggcgggtaaaggtatcgttatcctggggacgaaccggcgtaatcgccgcggcgaccattgcgtctttgtaggtctccagcgcccgctgcggctcgcccgtttgcgcctgaaaagcggcggcgtcacgcaataccatcgcgctttccattgatggcggctgtgcttttgcctgcggcgtaatgcggttgaaggtccgcgccgccgccgtgatatcgccaagctggagctgcgccagcgcgacgcggcgctgcatgttaatagaggtgatttgcgacgcaggcagcgccgccagctgagcgcgcgccgcagcgttatcgccctgtgcgatgtcgatttccacccgccccagcatggcatcgacattacccggttcccgcgccagaacggcgtcataagcggcgcgggccgccgcattatcgccacgctgctgcgcccagtccgccaacgttaacgcaatgcgcgtagagggcggctgctgacgtaacaacgcttccgcttcgcgttctttgccgctatcgcgcaagcggttagcgctttccagcacctggttactttgcaatcggcccgccagttcctgaatattgctgttccactggctggtcggcagggtattgagatgcgccagcgccgcccggtcccgatcgctgccggaaagataaagcccataagcatagacctgttccggatcgtttggcttctgctgcgccagagagcgcatttgcgcatcggcctgagcgtgctgcccggcctgccacagatcgcgtgacagtcggtacgtcacccacacgctccccggatctaatgccagccgacgacggtgcagttctgcggcctgcgcccatttgccctcgctttccagcgtttccgcctgctgcgccagacggtcattttccagactgcgttcgatatcgtcgatactgcgccgctggctggcggaaagagaagcgataaacgcggcggctttttgcggcgactgctggcgataaagattcgccagcccgcgtacagcattggtattaccgctatccatacgcagcgtctgctgataataacgttcggcggcggcattatctttgcgcgccatcgccacatcccccagccccagtaccgcgtagctgtcggtgttatccactgctcgcgcctgctgatagaaacgctccgcctgggccagattattcgcttttaaggccgcgtcgccctgctgaattaacagccagtagcgattgaccttcagcagactctcccacttatcgcggctgctgctgtgcggcgccatcgccagcgccttttcaaactgcgcgacggcgcgggcgcgatcgccacgctgtgagtatgcctgccccagcgcgccgaccgcctcgctgtcgtcctgccgggcgctcaccgcctgctgcaattgcgcaatggccttaccgccttctccggcattaaccgccgcgatgccctgcgagcgcgcacggaacgccggatcggctaactgtttttgctgctcgctaagctgggcgcgggcggcagacacgctatcgccttcgctaaactgcgtcagatagtcttgcaacgcttttacgctggcgtcgctaaccgggagatcttttatctgctggtaccagatggcggaggccgcgctgcgtcccgtactggatttcgccatctgtttaagcaccgcgaatccctcatcgcgccgcccgctggcgaacaacagttgcgccagcgcattttgcagagcgttattacccggactgacggcattgattttctgtagctggttaatcgcttcgtgacggcgggcgggcaatttcgccacggtcgtccagtattcgaccgccagttcgccctccggcggataacctttaaacagcttgtcgtagctggcgatcgcttgttcagtatggccggtcgtcgccagtaaacgcgcctcctgcaaagactggcgtccttgcggcgtggagagcagcatcgcggtgcgggaagattgatacgccgtcgactccggcgccagttgcgccagccggtcaagtagcttctgtgccccgtcgctatccccctggcgcaacagatagcggaaacgggcggcgataacctgtggatcattggggtcgatcagctccaggcgatagagcgactgacggactaagtcctcacggtgcgtggcctcgcccagccgaacctgctccagcaactgttgctgcgcggaggtcgctgcgccggcaagcggtgttagcgccataccaagcgataaacccaacaatgcccgagaaacgccccttttgccaggtaaggcgtttcgaccgccagccggcaaaaaagcgtgcatgagacttaacgtgaacttacgcattcctggccccagtcaggtaataattcacctttgacggtgaagcgaaaacggtgctgatcccagccttgtccaaagagagtcagcacatagttgtaataggcatcgctgccaggaaaatggtctgcgacccgctgtcgctgcacggcctgggcgtcgcgattttgcaggaaaggcagtaaggcggcggaaaacccgaccggccccgtcccttgcgcattcccgctgacgacatccactttctccggtggaacgccgtttttcatcgttaacgtcgccatcggtttaaatcgcgccagtaaacgcgctttttgcggatcgccatcatgcatcattcccgcccataaatagacgcgaatcgcatcgtagctactgatcagcgtcttttccgctttcaactgccagccttgcttgctttcataacgcacccagtccggcgagaaacctttcggcgcggtttccagcaaaagccgcaaattggtttcccgtaacgtcgaccacggcgcgccaaaacggctaaagtattgcgccaactgcggcggcagatagcttgggttaaaacgccagctattcgcctcggcaaagccgattttgccaggtagcagcattgagcccagccccggcacattcaggacctcttcgcgggcgatgcgttttagcaacgccgtgcccacctcggtataacgcgtctctttccacagacgaccggcctccagcagcgaccatgccatccagatatcgccgtcggacgcggagttgctgtccagcaccgaccaggtgtcgggatctttttgcccccacagccaggcgggcagatattcacgcaacgatccctgcgccagattgttttgcgtccagttaaacagttgcgcgaacgccggtcgatcgttcgctgccagggcaaagaacatggcgtagctttgcccttcggaggtggtaatttttcgcgcatcgcccggatcgataacgcgtccctgctggctaatgtaatctttcttgaactgttcccacgcaggccagctacaggctgcctgcgcatttattgccgtcagcatgacgagcatcgttatccatccgcgcagcatagtcatcatgcgttactcatggtcagggtcgagacgacggcgactgagaatacgtagcagacgccacaatacccacgccagtaataccacactgagggccgccagtaccgccagcagcaccgggtgattcgccagcgcataccacagccgctcaaaccacggcagatgtccgacgtaatagatatcgccaacgcgcagactgtgaacgccggactcgcggatcaccgccacggaaccaaacatcgcggcgcgtttaccgctgtcgttcacggcgtcgttcagtagctggtaaccgcgcgggctgtcagccagcagagcaatcacgctgcgctgatcgttaaacggcgactggaagcccaccaccgccgccatcgggccgctggcggtgacggtggactgcgcatccgccgcgcgatcggcctcatccggcataatcgacgggaaagcggtctgccgcatcggggtttttacccagctttgtgtcgcctgcaccaacagatcgatacgcttatcgtcttttagcttgcccggaatagcgctaataatcagcagatcggcgtctttgtcggctatctgagcgctatcatcggtgattgtcagattaattgccgggaaaccggtctgtccgccaatggcgccgaccgtattcagcagcgtttccatttgcgcttcggttggggtcttcggcatcaccgccagcgtgtcagacaggtcggccatccggctgaacgggaaacccgcattggcgaacgcgcgtaaatccggcatcgcgataaagtggtaatatttcgaaaaatcgatagtggagtcatcccctatcaccacatgattcggtaccggctggaaggtaatacagttgtccaccgacccgcccggcatcggattcatatagcggaagtcaaaacgtagttggttcatcgcccccagtttgagcgccggaatagacacatccgttttaccatccagcagtccctgaagtaccggcaggcgcaacaggagtcgattagtttcctgcgtgctgttaaggctaaaggcttgcaggaactggttattcagactgatatccagccgtgaactgtctttggtcggcggcgaggtataacggtagttgagatccatatcaataccgttgctacgcagcaaatagaggtccggcggcagattcaaagaaacgttgatgggcgccggctccagcccactcgactggagctgctcttcataggttttcagctcgccaaaagtgaccgggcgatcggtacgcacccagttcggcgcatcatacggtttgcgcgccagcagcggttttacatcgttgaccaccacgctggaaccacggaagagaatattcccttgtgcgataccttttgccgcctgcaacaggtctttatcatctcgaccaaacacaaccagcaacttcacatacggattatccggatggctcatcatctcgataaccggcgcgttaaccgcaggatgatcgcgcaggaaatcggggcgtcgatcgttggtggcgaacacgatcgcattgcgatccggcaggtgattatacaacaccgggaagcgctgaccgcgccagcccgcccgcgatccaaaccaggacgcgacaatagaagccgcctgctgctgcgccagatccggcatatcagcaaacactatcggcaacgtcactggacggttatcccgcggatcgaaaaacggcaccgggaagtgggacagatcgttattcaccgccagcatgttataggtcagatccagggcgctatttcgcccgatgtctaaccacagagtactgctggccgggttttcacacacgtcgcgatagtggccgacaaactccagccgcacccggttaaagtcggtgataaatagcggattgataggtacctgcgccagcgtctttttccccaactgctcttttgtcaccggcagtacgcccatcagttcatcattgagataaaccttgagctgcgactgaaccggcaggagcgacggcgagggcgtatattccagattcagcaccgctttcgacgccacttcatcgctgcgcataccaaattcaatgccgccgttagggttaacgccacgcagcgccatactacccggcggcggcgcgatttgcgcaaaggtcagcttgacctcgcgcgaaggcgcggtctgcgccacgacgggcgcctcagttgcgggcgacggcgcaggctcggtgggttcagcatttatcaatggcggcgtagcaggcgccgccgccgtcatgaaagcaggaaacgcgcttaatcctattaccgccgcacacatccaggacaattttcttttcatcgcattatcatcattgttgagcctgagccataacccgatccgacggctgtatcgccgcttgccgctccgggcgacgcggaataaacgatacaatccaggcaattaacgccgtcaacgatcggaaaattacttttactgaaggcggcgcgaattccgcgaggtggcgatatccgcggaagcccagcttcagaatatccagcaagctttccagcggtttatcttccgggaagctatcttgccaaagcgcccacgtatcggcgcgcgcgaaggtacactgcacaaaatcaatatgttgtttggtggtgagcggcatcagttgtagcccgacctcattgcccgttacgcgcaccacctgcgttggaaagacatattcctgctgcccgcgtttaagcaacagattcactttctgcccttccagcacctgcgcctgaccgttgatcttgatgcctaacccgccgtcggagaagtcatgtacggtacaggagaacaaatgtccatcttcgcgggcgatggcccccggcatggcaatctcgacccgatgcgcgcgcctgacctgtttactctctaccgaaaccgcaaccgcgccgccgagaatgaccaggttatagaagacccacaccaggctaacgatgacggtcagcgtttcattttccggcccgtaatagtatcgccatacgcccgccgccacgccgagcaggttaagcaagacaaggaagatatacggacgcgagattacccagtcgacgtacttctcttccaccagcccgcctttcgccgtgacgttaaatttccctttgtgcggattgatcaacgcgaccagagtcggcggtgcgatataccatgccagtaccgtttcatagatttcactccagaaagagtgacgatacttgccctgaatcttcgagttagtcaggctggcgtggaccatgtgcggtatcacaaatagcgcaatcatcaacgcaggcgcataaatgatataggcgtgcagcagcagaaaagccagcggcgcggtcagaaagatcaggcgcggaatgccggacaagaaatggaacatcgcgttgaggtagcacagccgctgcgccagttttaagcctttaccaaacagagggttatcgaggcggaaaatttgcaccataccccgcgcccaacgaatacgctgcccgatatgcgccgacaggctttccgtcgccagccccgccgcctgcggaatgcgcatatacgctgaggtataacctcgccggtgcagccggagcgaagtatgcgcatcttccgtcaccgtctcaacggcgataccgccaatctcatccagcggcttacggcgaatcaccgcgcacgatccgcaaaagaaagtggcgtcccacatatcgttaccgtcctgcaccagtccgtaaaacagcgtgccttcgttaggcgttttacgaaaacgtcccaggttgcgctcaaacgggtccggggagaagaaatgatgcggcgtctgcatcatcgccagctgtttttctttcaggaaccagcccattgtcatttgcagaaacgagcgtgtcggcacatggtcgcaatcgaagatcgccacaaactcgcctttcgcgtgttttagcgcattgttgatgttgccggctttggcgtgttcatgcgtggtgcgggcaatgtaatgcacgccaacatgtcgggcaaaatgacgaaatgattcacgcccgccgtcatcaaggatccagatattcagcttgtccttcggccagtcaatgccaagcgaagcgtaaatggtatttttgaccacattaaggtcttcgttataggtcggtacaaaaatatccaccgtcggccactgcgacatttctttcggcaacggcaccggttgacgatttaacggccacaccacctggaagtaccccagcaccagcacaatccaggcgtaggtttccgcaaacagcagaatcagcccgcacaccagactgaccgggtcgtcccaatttagcgtcgaggtatagcgccaccagatataacgacaggagaccgttaacgacagcacgatgagcatcagcgcggaaaagcgtcccggcatacgtcgtaccaacagcgcaacgccccacagcaacagcagaaagataaattgcgatagcgggttaaatggctgcgtaatacagatcagcgccagtatcagtgaaaaggtcacgataacgcccagaataaaacgccgggcgccgttgctaagatgtcccagctctttttccttttccaggtgcgttgtcttttggcgcacccgttccggtaaggtatccatccattgatggtaacgtccacgaacgtccttcaggcgcgcaaatgaccgccagcgcggttcatgacgttctttagtcgacgagatcatcaccagccagagggtctgaatgaggtaacgggccgggtccagcgggcgcgggcgtgcggcgttaatatgcggataaagcgctttatgcccgtcgcgaatacgctgccagcgcggatgctcaagcggaaacactatccacgccagaatcgtccacaggcagccgagcgctgcgctaaacggcgacgcgccgtggcggcggtaaccctgatagcgctcgctcaaacgcgcgctaaccggcgggataagcagccaccgggaaagggcgctcatcgcaggctcccggcggacgttttgtcgcccgcatcatgcagcaggcaccagttcgccagcgttaacacctcttcggcggctaacgaatcgctgcgatattcgcctaacggctgtttcgacgccatgcactccgccatcgcctcatcgcgatggatcacaatgggcagcaaccggcgctggctttgcagccagacctggtacagatcgtcctgtaactgactgccaatgcgtaagtcattgatcagaatatgcgctccggcaggcaacgcctgctgatgaaggcgaatatggcagttagcgtcaacccgggctatcgccagcgtatggtcgcagaggctcaccagttgccgtgtcagcggtgacgcgccgtagggcaagtccagtaaaatccagctataacgcccgctcgctttcagcgcctggatagccgatccgatctctcccagcgtctcctgccaggactgcggattttcccgctcttgcgcggtgagctgtccaaacggcagtagatcaagctgtgaggtataacgtaatccggcatcgcgccagtcctggccgtccagcaacgatcgcgcccaaccgccctgatggacgaagtcgacgttaaacgacatgcgcagcaggttatcggggctggcgtcaatcaccaggacattttcccctaagatttgtaacgcccaggcgagtgctgcggtgagagatgtggttcccaccccgccgcgcacgccctgcagtcccagaatcgccattcatggcttccttaatgaatgtggttgcgcaaattcagccaggagcggccatcttttaatcgccgccgccaactgttcgcgttgggaaatatcggtataatctatttcgggtagtgaaaacgcctggcttaatgccagaaaatcattttgaaaagtgtagcccaacgttggatcggactgagcgccaggttcattgttatacattctggttgctcctttttaaatatttctcactggcagcattacgccccgtcgtcaatacgggagaacgcgcatttttcatctttccgtgacatcatttataatgtgtaaaaatgcaaagcgcagagttacagggcatcctgccgggcaaattgattcacatgctaaatctgatgcgttttaatttcaatgttaggtttatttctgtgctttcgctagtaaactgataaacagttaaaatagtgacatgagggacactgtggaccccgtattttctctcggcatctcatcattatgggatgaactgcgccatatgccaaccggcggcgtctggtgggttaacgccgatcgccagcaagatgccatcagtctggtgaatcaaacgattgcgtcacaaacggagaatgcaaatgtcgccgtcatcggcatggaaggcgatcctggcaaagtaatcaaattagatgaatctcacggtccggagaaaatccgcttatttaccatgccggcttcagaaaaagggctatactctttgccccacgatttgctttgttctgttaacccgacgcattactttttcattcttatttgtgcaaataacacgtggcggaatataacgtcagaaagcctgcataaatggctggaaaaaatgaataaatggactcgttttcatcactgttcattgttggttattaacccttgtaataatagcgataaacagtcctcgttgttgatgggcgagtatcgctcactttttggcctcgccagtttacgttttcagggcgaccaacatttgttcgatattgccttctggtgtaacgaaaaaggcgtcagcgcccgacagcagttattgctgtgtcagcaggacgaacgctggacgctatcccatcaggaggagacggcaattcagccgcgtagcgacgaaaaacgcattcttagccacgtcgccgtccttgaaggcgcgccgccgctctcggaacactggacgcttttcgacaataacgaagcgctattcaacgacgcgcgcacggcgcaggccgcgacaattattttttcgcttacacagaacaaccaaatcgagccgcttgctcgtcgcattcatactttgcggcgccagcggggaagcgcgctgaaaattgtcgtgcgcgaaaatatcgccagtttgcgcgccaccgatgagcgcctgctgctgggctgcggcgcgaatatgatcattccctggaacgccccgctttcacgctgcctgacgcttattgaaagcgtgcaggggcagcagttcagccgttacgtaccggaagacatcaccacgctactgtcgatgacgcagccgttgaaactgcgcggttttcagccgtgggataccttctgcgatgccatccatacgatgatgagcaacaccctgctccccgccgacgggaaaggcgttctggtcgcgctgcgcccggtgccgggcattcgggttgagcaggcgttaacattatgtcggccaaaccgaaccggcgatattatgaccatcggcggcaaccgtctggtgctgtttttatcattctgccgggtcaacgatctggataccgcgttaaaccatattttccctttgccgacgggcgatattttctctaatcgtatggtctggttcgaagataaacaaatcagcgccgagctggtgcagatgcgcttattgtcgccggaactgtggggaacgccgctaccgctggcaaaacgcgccgacccggtaataaatgccgaacacgatggccgcatctggcgtcgtattcctgaacccctgcgattgctcgacgacaccgcggagcgtgcatcatgatgaccatcagcgatatcgtgcaaattattcttttttgcgcgctgattttctttccgctggggtatctggcgcgccattcgctacgccgtatcagtgatacgacccggctgctatttgccaaacctcgttatgtaaaaccagccggaactctgcgccgcgctacgaaagtcaaggcagacaaaaaatgactcagcatactcaaactccttcaatgccttctccgctctggcaatactggcgcggtctttccggctggaacttctattttctggtcaagtttggcctgctgtgggcaggctatctgaattttcatcctttactgaatttggtattcatggcgtttctgctcatgccaataccaaagtatcgccttcaccggttgcgccactggattgccattcccgtcggcttcgcgctgttctggcatgatacctggctgcccggcccgcaaagcattatgagccaggggacgcaggtggcggaattcagctccggttatctgctcgatctgatcgcccgttttattaactggcaaatgatcggcgccatcttcgtactgctggttgcctggctatttttatcacagtggattcgggtcacggtgtttgtggtcgccatcatggtatggctgaatgtactgacattaaccggcccggtttttacgctgtggccggcaggccagccaaccgatacggtgacgacaactggcggtaacgcggccgctaccgtcgcgacagcgggcgataagccggtcatcggcgatatgcctgcgcaaaccgcgccgccgacgaccgcgaatctgaacgcctggttgaacaccttctatgccgcggaagaaaagcggaaaacgacgttcccggcgcaacttccgcctgatgcgcagccgttcgacctattggtcatcaatatctgttcgctctcctggtcggatgtcgaagcggcaggcctgatgtcacatccgctatggtcgcactttgacattttgtttaaacactttaattccggtacgtcttacagcggcccggcggccattcgtctgctgcgcgccagctgtggtcaaccttcgcatacccgactttatcaaccagccaataacgaatgttatctgtttgataatctggcgaaactgggctttactcagcatctgatgatggatcataacggtgaatttggcggcttcctgaaagaagttcgcgaaaacggcggtatgcagagcgaactgatgaaccagtccggcctgccaaccgccctgctgtcattcgacggctcgccggtatatgacgatctggcggtcctgaaccgctggttgacaggggaagaacgtgaagccaattcccgctccgcgactttctttaacctgctgccgctgcacgatggcaaccacttccccggcgtcagcaaaacggcggattataaaatccgcgcgcagaaactgttcgatgaactggacgccttctttaccgaactggagaaatccgggcgtaaggtgatggtagtcgtcgtaccggagcacggcggcgcgctgaagggcgacagaatgcagatctcaggcctgcgcgatattcccagcccctccatcaccaacgtcccggcgggcgtgaaattttttggcatgaaagccccgcatgagggcgcgccgattgatattaatcagccgagcagctacctggcgatttccgaactggtcgtacgcgccgtggacggtaagctctttaccgaagacagtgtgaactggaacaagctgaccagcaatctgccgcaaaccgcgccggtttcagaaaacgctaatgcggtggtgattcagtaccagggtaagccctacgttcgtctgaatggcggcgactgggtgccttacccgcagtaaaccgaaaaaggccgcaaggtttcccctgcggcctggttcgggcgcatgttgccattacggcggacagacgctcaaaacgcgttacttcctgtcacgtagccagttgacgatcacactggcgataatgccagcaatgatcggcgctgccagatcgtgccagaagaccacgcccaactgcgtaagcgtcatatagccgccttgttgcaatggcaaccgttcgcggctatccttaaagtgtttgggttcaagttagcccccgtcaggttgccaggtttataccagtcaacgtgcgggggttttctctatccagcaacctatgccgccggggatcaaacccccgcaacattgcgcctcaccgggtaaacccggcttgctgctgatattacggcaaaatccccgtcccggcacggcgctaacgtgcaatctgcgtgacgcttcgcagacgattacttttatttgccagaatacattcagcatttctgaggctggcagtcagccgctcaattctgtaaattatgcctcctcgcggccagtcccggtgataccgaaaccctcgttcagcatcctgcgtctatgacatattcgcctgttgcgccagaggaatggctaaaagcaggtattaccgacgaacttatccgtctttcagcgggacctgaagatcccgacgatattattcatgaccttgaacgcgccagcagaaaagcagcattctgacgattgctcggcgaaccgctgtcaccggtttgccgcatcgggtatcaaggcactatagcctggttataggcagcattctttatgagagagctgcgtatattttgggcagggggctctatgcaggacgacacattaccattaaataacagtaacgctacgaccacaccgctttcaacgagattaccgtttacaaaatatgattttggctgggtgctcttgtgtatcggaatggcgatcggcgccggtaccgtcttaatgccagtgcaaatcggtctcaaggggatctgggtatttattaccgcttttatcatcgcctatcccgctacctatattgtgcaggatatttatctaaaaacgttatctgaaagcgaaacctgtgacgattatacggatattatcagtcactatcttggcaaaaactggggcatttttctcggtgtaatctattttcttatgattatccacggggtgtttatttattccctgtcggtggtgtttgatagcgcctcctatatcaaaaccttcggccttactgaggccgatctttcgcagtctattatctataaagtcgcgattttcgccgtgctggtggcgattgcctccggcggggaaaagttattatttaaaatttccggcccgatggtggtggtaaaagtcgggatcattctgatattcggtttcgcgatgatcccacactggaatcttgataatatttccgcctttcccgccgcatcggttttctttcgcgacgtactgctcactatcccattttgcttcttttctgcggtcttcattcaggtgctaaacccaatgaacatcgcctatcgtaagcgcgaacctgaccgtgtgctggccacccggatggcgattcgcacgcatcgcattagctatattacgctgattgccattattctctttttctcgttctcgtttaccttttcgattagtcatgaagaggcggtatcagcattcgagcagaatatttccgcccttgcgctggcagctcaggtaatccctggccatatcatccacattacctctaccatcctcaatatttttgccgtacttaccgcgttctttggtatttatttaggttttcacgaagcgcttaaaggtattgtactgaatgtattgagtcgtattatggatgtcaaaaacgtcaacccactgttactgacatctggaatctgtgtctttatcgtggttactctggttatttgggtttcgtttcgcgtctcagtattggtctttttccagttaggcagtccgctttatggcattgtcgcgtgtattattccctttttcctgatttataaagtagcgcaactggaaaaattacgcggcctgaaaacctggcttattctgttatatggaatattgttgtgcctgtcgccgttattaaaattgattgaataagtcgtaccggagagccatgcccggtggcgctacgcttaccaggcctacaggtacggtgtaggcttgataaggcgcagccgccatccggcataaaacgcaattaactcagcggtttctgcggattttcatcctgatcgacggcaaagcaggccaccaactggccgtcgtactctttaagctgcggctgtaactgcgtacagggtccgaagcgacggctgcagcgggcgttgaaggcgcagcccggcggcgggttcagcgggctcggcaactcgccggtcagcttaatccgctcacggcgatcgtccggattcagccgtggcgtggcggagagcaacgcctgggtatagggatgacgtggattgttaaaaatctgctctttggtccctttctccacgcagcggcctaagtacatgaccatcacttcatcggcgatgtgttccaccaccgacaggtcgtgcgagataaagacataagacagccccatatcctgttgcaaatccatcatcaggttcagcacctgggcgcgcaccgacacgtcgagcgcggagaccggttcgtcggcaatcactacgtccggatcaagcatcagaccgcgggcgatagcgatacgctgacgctggccgccggagaacatatgcggatagcggtcgtagtgctcggttttcagccccaccttcgccatcatcgccagcgctttttcacgacgctgcgctttactcaggctggtattgatcagcaacggctcttccagaatttgccccactttcttgcgtggattcagggaaccgtaggggttctgaaacacaatctgaattttctgccgccgcagtttctgcgcgtgcggatcgtgtttaagcagatcctgcccctggtaataaagctcgccgccggttggcgtttcaatcatcgtcagcaggcgacccagtgtggattttccacaaccggactcccccactacggccagcgttttaccgcgttcgagattaaacgacacgccgtccagcgcttttaccagccgttccggagaaaagatccccttcttcaccggatagtgttttttcaggtcgatagcccgcaacagcggctgttgcaaggtggcctcatgcgtactcatagtgtgggcctcccggcatcatcgagtgggtaatgacattttgactgacgtccatcgtccagttggttgagagcaggttcttccgcacgacatctgtccgtggcgtaggggcagcgcgggttaagcagacagcccgtcggtcggtcatatttccccggcaccacgcccggcagcgacgccaggcgcgctttgtcctgagcaaactctggtaacgcgcgtagcagtgcctgggtgtagggatgacgcggcgcgcggaaaatatcctgcgcagcgccggtttcgacgacctgcccggcgtacatgacgataattttgtgcgccgcttccgccaccagcgccaggtcatgggtaatcagcaccagcgccatgttctctttttgctgcaactccagcagcagctcaatgatttgcgcctgaatggtcacatccagcgccgtggtcggttcatcggcaattaacagctttggtcgacaggctatggccatcgcaatcatcacacgctgactcatgccgccagaaagctggtgcggatagacatccagacgagaagccggatcgggaatacccacctggttcaacaggtcaatcgctcgctgacgacgggttttcttgttcccgccctgatgtaccttgatggcttccataatctgaaagccaacggtatagcaaggattgaggctggtcatcgggtcctggaaaatcatcgccacttcagcgcccaccaggttgcgacgttccttctcggaaatgcgcttcagatcctgtccgttaaagagcaggttttccgccatcacgcggcctgggtaatcgataagccccataattgccagcgagctgacggatttgccggaaccagactcgccgacaatcccgaccacctcaccctgcttcacgctgtagctaatgcggtcgacggctttgaacggtgtcccttcgtcgccgaagtgcaccgataattgatctacatttaataacgccatctcgaacctcttactgcttcagtttgggatcgagcgcgtcacgcagaccgtcacccatcaggttaaatgccagtaccgtcagcagaatcgccagccccgggaaggtcacgacccaccaggcgctttgcgcgaactgcagaacgtcagagagcatggtgccccattccggcgtaggcggctgtgcgcccatgccaagaaagccgagggcagccatatcgagaatggcgttagagaagcccagtgacgcctgaacgatcagcggcgcaaggcagttcgggaaaatattgacgaacatctgacgcatcgcgcctgcgcccgccacgcgggaggcagtcacataatcgcggttcacctctaccagaaccgccgcgcgggttaagcggacatagtgcggcagcgccacaaacgtcaacgccagcgcagcgttgccgatggaggggccgaagatcgccaccagcaccagcgccagcagcaggctcggcagggccagcataatatcgaccacgcgcatgatgatgttatcgaccagaccgccgaagtagcccgcgaccaggccgagaataatccccattaccagcgacaggacgaccaccagacagccgaccagcagtgacaaacgcgcgccatacatcaggcgcgagaggacatcgcgaccaacatcatccgttcccagaatatgcgcccaactgccgccttcctgccagaccggcggcgccagcagcgcatcgcggaactgctctgccgggttgtacggcgcaataaagttggcaaacaccgcaatcaggatcacgatgagaacatacgccagcccgacgaccgcgcctttattgcgtttgaaatagtgccagaactcccgcaatggcgtcatgggcgccggtgcggcattaacattattttcagtaacctgtgacatgatggccccttacttcttatgccgaatacgcgggttcaccacgccgtacagcaggtctaccagcaggttgacgagaataatcatcgtcgctaccagtaacacgccgccctgcactaccggataatcgcggcgttgcagcgcatcgatcagccagcgccccagaccgggccacgagaagatagtttctgtcagaatcgcgcctgccagcagcgtcccgacctgcaggccgatcacggtgacgactggcagcatggcgttacgcagagcatggacgataatgacgcgcatcctggtcaaccctttggcgcgtgcggtacggatgtaatcctcccccagcacttccagcatcgacgaacgggtcatacgcacaatgacggccagcgggattgtgccgagcaccatcgcaggcaggatcatatgcgccagcgcatcaataaagttaccctcttcgccccagatagcggtgtcgatcagcataaagcccgtcaacggattggtatcatcaaggaacaccatatcgctcacgcgcccggaaaccggcgtcaggttccagtggacggagaccagcatgatcagcatcatgccccaccagaagataggcatagagtaaccggtcagcgccaggccaacggcagtgtgatcgaagatagaaccgcgcttcactgcggccagcacgcccaccggaatccccacggcgacggcaaaaatcatggcgcagacgccaagttccagcgtcgctttaaagcgaggcacaaactcgtcccatacagggattcggcttttcagcgagatgcctaaatcgccatgcatcaccccccagatataatggaggtactgctgccacatcggtttatcaagaccgagttcagccagcagttgagcatgacgctcaggggaaatacctcgctcacccgccatgatcatcaccggatcgccggggatcatgtggacaaaggcaaaggtgagaagggtaataccgataaacgtcgggataacgagtcccaaacgtcggagaatgaactgcaacataacccgaattctctctcatgacccacggcctggaaccgtgagtctgtattgctcacaaatcttatcccacgcaaactgcatcgcggataaagcattacgccggatggcgctgcgcttatccggcctacacaacaccggggcgcagcgctcttttaattattcgacagagacgttttcgaagtgatgtttgcctaatggatcaaccacatagcctttaacttctttacgcactggctcataaaccgtggagtgagcgatgatcagcgctggcgcctggtcatgcatcacaacctgggcctgtttatagagctcaatacgcttgttgtggtcatcggtcgcacgcgcaggctgaatcaggtcttcaaacggcttataacaccattttgaatagttggagccttgctgggcggcatcgcagctgaacagcgtggcgaagaagttatccggatcgccattatcgccggtccagcccatcatcaccgtctggtgctcgccatctttagcgcgcttgaggtattcgccccattcataggtgacaattttggcctgaacgccaatcttcgcccaatccgcctggatcatttccgccatacgacgcgcattcgggttatagggacgctgtaccggcatcgcccacagatcgatggtgaagcctttttccagaccggcttctttcagcagcgccttcgctttttccggatcgtagccatagtctttaatatcgtcgttgtagccccacattgtcggcgggatcaggtttttcgccgcaacgcccgcgccctgataaacggctttgatgatggcctctttattcacggcataggtcaacgcctggcgaactttgacatcatccagcggttttttctgcacgttataggagagataacccacgttcagaccggcctgctccatcaggttgatgtttttatcttctttcatgcgcgcaatatccgccgggttcggatacggcatcacctgacattcgttcttctgcagtttggcgtaacgcacagaggcgtcaggcgtgatggagaagaccagacggtcaatctgcggcttcgtgccccagtagccgtcaaaggctttgtagagaatgcgggagtctttctgatattgcaccagttggaacgggccagtgccgaccgggttcagatccactttttccggcgtaccggctttcagcatgttgtcagcatattctttggaaagaatagaggcaaagtccatggctaaatcggcaaggaacggcgcttccggacgcgtcagcacaaactgcaccgtgtgatcgtcgaccttcttcacttcgctaatcagatccggcagccccatgccttcaaagtattcatagctgccgccagacactttatggtacgggttctgctcgtttttctgccggtcaaaagagaacacgacatcatcggcgttcagctcgcgcgtgggtttgaaatccttgctggattgccatttcacccctttacgtaggtggaacgtataggttttaccgtcttcgctgatatcccacttctcagcaagacccgggatcacttccgtggtgccggttttgaattcaaccagacggttatagataggtacggagctggcatcataggtggtgccagacgtaaagagctgtgggttaaagccttccggcgagccttctgaacaataaaccagggttttggcctgcacgcttgctgcaacggtcatggccaccaggctcaaaccaagcttcagcatccctgacttcttcaaggaaatactcattcttctgctccaattgtgatgtatgttgttttgccctttgcaaaggcttttaccgcccggccttttttgttttttacctggtcaggtcagtagtgagaggtggggattccgttcgcataatcgactgagttgcagtgcggattctccataaaatgcccctcattccctacaatctgtcaatagaatgtcaaaacgtcaatacaggtaaccagcttttacaacaacggtgagaattaacaaacaaagattaaaaaaagttcagaagggtattttcagcagggaaatttgtgctatggccagaaaggcagagttattcacttaatattttgcaacagttagtgattaacaattagacattaattgaaaaatttctttcgatatgttgattatctgagcgattaataccactaacgctaaaacgcacaggcgaaaatgctgaggttatccataagccgtgtgcaaaaaagagttatacggacgttgaaaaacaccatcgaatatgtcacaaaattgtaaataagtaggccgtcgtgcggcctaccgcgatcacaaaaactaacttttgaccctggcctgcgtgcgcttttcgctccagttaaacaacgagttcaccagaatcgccgtcaacgtccccgctgccatgccgttgccaaagaccatctgtacgcccgccgggaaattctgatacaggccgggtaccagtataggtagcattcccatggccagccccatcgccagcgcgtaggttttacccggcgtatgcagtggctcacgcgcaatcatatcaataccgataaccccgataatgctgaagacaatcaccgccgtaccgcacaccaccgaacctggcagacaggtcgccagacgtaccagcggcgcgaatatggcaatcaggattaacaatcctccggcagccgcagtcacgaaacgcgatttcacattagtggtgcgtaccaccccaatattttcgccggaggtgataattaaggaggtgccaaaaatcccccccagcagcgacattaccgcatcaccacgaatggtgcgtggaatcgcctgctgcacattttgcgtggaattgactatttccgcggtcgcaatcgtttgcccggttgcttcagccatagagatgaccgcgtaaatcagtaacggcagcgaggcggagagatcaaaaatcggccagccgaacggcaaaagctgtgggaaactaaacagcggcccgtgactcacaccgctaaaatcggtgctgcccagcgccattcccagcaacgttcccgctaaaaggccgaacatcaccgccagctggcgcaaaataccgctaaacgccagcgcgaaaatcagcgttatcaggatagtccccagcgataaaatgatactggttggatgagcgaagtcggcgctccctggctggccaatgatcaatccgccgtacaggcgaataaggttaatcgacaccattagcagcatgatgccaatgataaaagggggaaaatggtgcaggcagcggcggaaaatcggcaacgcgataaagtagaacagcgaggtcagaattacggcgccaatcgcggtctggatattggtctgtaaagcgatcgcaacgaaaatcgcaatcggcgcgccccccggtaccataataaacggcaaacgcgcgcccacccctttcacacccaggctttgcaaaatagcgcccagaccgcacatcagaaaggtcgcgctaagtaccgaggcggtcaccgtatcggtaaagtggagcgctttggcgatcagaaagacggaggtaatgggggtggcggcaacgaccagcacatgctgaagcgccaaaagtaaggtggtttgccagggtaatgcatcgttatccggcgtagtaaggccaggttgcggcatgattaactcccataaaacatcaaaaaaataaccgccagcgcgggctggcggtctgtattatttcaaccaactaatggcatcagcggcatagcgatgcgcacggaaggcgctgttctgttttccaggaataatgcctttactgaggtgctccggatattcattaaagaacggaatgatatattcccataccgtttcgccttccggggtgacttcaaacaggcggccaaacgccgattcacagataaaggtgttgccgttcgccagccgctgcgcgctccccatatacggcgagaaaaacgccggcgggaagatatcgcgatactgccaggtaatcgctttggtctgcggatcgaactccagcaccgtggaatgcggcgaggtgacgccgggacgcaggttgccgttatcgaaaaccagaatcgacccgttctccatctcaaccggcgtgtgctgctgcgctacgacttccggccctgcatgccagataaccttcccgctctctttatccacggcaatgacgccggaagtggtacgcaggctcatcagcaccaagccatcacgggtgacggacaggccgttaatcatcggccagtggcggcggtcgaaaatatcatgaatcgggaaatcttccggattcaaatgctcccaggcgcgccattcccagaccacttcaccgtcgcgattgacctctttgacgacgtcgctctgaatgatgccgtccggcgcatcgcggcgcgggtcgccgccggtaacacgggcggcgatatcggcaggcaacggcgacgcggcggtatacagcagattaccgttcgccaaccattgcgcatcatggtgatggtaaatatcttcgtaatgccagacgatttcgttatccggcgtcacttcgtagaagtcgccgccgtgccagagatcccacgccggatagaggttcgctgaagtgcggtggctgccgttataacccagattaccgttcggcagcagcaccgcatcacgcccggcgcgaaccggaagctgccactgatgcgcgacttcgccctgctcgtccaccaggtaaacccgcccttcggcggtttgcggcgcaaaaagcgtatagccgccaaagctcttcgccttatcagcgtagataaggcccgccagacggcgtccaagggtgaaagtcgaatcctgagttaagtgtgccacatcgcctcctgaggaataaatttgcgccaaaataccccattaaaacgttttaatgaagggttttttacgatcctcactgaaaaaaagcaaacgttaccgtctggtaaatatgctaccctgtgcgcaaattttcgcaggtcaggaagcagatggctgttcaaaataaaaaacgcgcaaagttgattgatgttgcccgccatgcaggcgtgtcgccagggacagtatccaatgcattgcacaacactcgctttgtcgagccgcagacgcgacggcgtattgaagaggccattgctgcgctcaactacacgccgaatattcgcgctcgccagttacgaaccggcaaaaccaataccattgctttgctctcttcggtgccgctggcgattgcctccggcgcatcacgactgggatttatgatggaggtggcgttaacgtccgcgatgatggcgctggaaaagcagcatgcgctgattctggtgccgccgggggcaaatccactggatgccgtcagctttgacgcggcgatcctgattgagccggcggagaacgacccgcagctccaggcgctggcgcaagcgggcattccctgcgtcaccattggccgcacgccggggaccgacacgcctgtgccgtgggttgagctgcactcggcggcaacagcacagcttctgctaacgcatctggagacctccggcgccagcaaatgtgcgttatttgtcggtaacactcggcgaacatcagttctggagagcgaagcggcttaccagcgctggtgcgcggggcgccaggcccccgtcgtctactctctcaatgaaagcgagggtgaaaatgccggctaccaggccgcgcagcagctattacaggcgcatcccgacgttgacggcgtgctggtgctgatcgatacctttgccagcggcgcggtacgcgctttccaggaacaggcagtcgctatcccggagcggatgcgcgtggtcacccgctatgatggtatccgcgcgcgcgaatcgctgccgccgctgacggctgtgaacatgcatcttgatgaggtggcgcgacaggcaatcacgctcctgtttgccgttttgtcgggtgagaagatcagctacagcgacgggatcatgcctgaactggtggtgagagcgtcaacctgccggtgatagaggatgactcgccactacgtggctcgccctgcgggccgttgctgacgcaacgttctctcgcttcgctcgagtcgaacctcttgcccccggaggttctcatcctcgtcagacttcagatacaaaaaaaccctgctcattgagcagggtttctgaatttggtcggtgatagaggattcgaacctccgaccccttcgtcccgaacgaagtgcgctaccaggctgcgccaatcaccgaatgcgggcgcatcttactgctcaggcgcacgcccgtcaatcccttagtcgcaaaatacaattcaatcggcgagaaagtcggcagacaacctacttcgcggcgactttctgcacatcgggaatatggcaccagttgttgttctggttaatgccgccattcggcgatgtataccccaggcagcccattatcgtatcgtatagctccacatgacgacgcggcactttgatctccgcctgctgtttcaggtgagcgaacatctgcgcatgttgcggactggcaagatatttatccgacatccataccagcatcggaacacggaattgctccggcggcgccatattgcgcggcgtaccgtgcaaatgttcgcgttcgttaatcgactcgccgtggtcagccgcgtagaacacaatcgcttttttatcacgtagctgatcgaacacactggtaataaagtgatccacataggtcacggagttatcgtaagagttgatcatctgcgctttcgtgcagccgctatcgaccccaatacattcgggcttccactgagcgtagctgcgcggataacgctgcgtatagttaaaatgcgatcccttggtatgcaggataatcagatgcttaccctccggattctgggcaagcgagttctgcatctcatcaatcaacagcatgtcatccaccgttttaccgcggttacgcggctcggcgccaatctgctcgcggtaagagatattatccgccatggtattgctatagaaccacatctcgctctgcatggcgtacagatcggaactgaatccgagctgtttgagtacggcaaaaacattctgctcttttaaggtacgctgcgggttattatccgccccgccttcccgtacaaacatacagcgtaaagaaagcttcgtcgcggtatcgcaggaatagccgcggaacgccgccagatttttttcctgcgccagcttcggcgtggtattacgctcgtagccgaaaatccccatgtgatcccaacgggtcgtctcaccgataatgaaaacgacgtaggtgtcatccccatctttcggcgcaacataggtaaatttcctggccgggtttattaacgaattattgtccgacgactcatctacctgcgcccaggcatacagccctaacgcagataaccagtttgagggcaggtaggagttcgccaccacgccgccatagctgggtaagtcgatgcctgtcgcccgttcaacctttttttgctgtatatccagcaggcgaataggcgcccacaccattacgcctgcgagtaccactacagcggcgctgcgaaaacgctgccccggcgtacgtagctggcgcaacaacgtgtagcgacagtggttactccagataaagatgagcggaagcacgctcacggcaatcagccacaatacaaagtgcagccccaccacctctttcgagagatcgatatcggtggtcataacagacgcaataatgccgtagccaatcaccacgttcaggaaggtcatgtaataactggcgccagcggaaaacagcaccaccagcgtggccagcacacgccagacgcgtcggccaaacagtgaaagaagacgaagtaagaagaaagtgaccagcaccgtggcgcccagttcgacaactgcggagaggcctttccaaatggtaaattcttgtgcataactgccgaaacggcggtaaaacacggcgcaattcataaacagaccgatatagagcgcaagcaagaaactaagtttctgttgcgtcatcgatttaatgtatctcatgcaaacaaaccctgggaatcgggataaaaacgacctgtacaacgattctttaatcaaacaggtaaatatgcggctaacgcagatgtaagaaagtctacaagcacggttaagtagaccacaagcagaggggaaagtggcaacggagagtgtgatcggagaagatttttacaaaaaatcactaaaaatggaaaagggccagcgaactggccctcagtgattattcgtatgtgacgctaaaattcaccgtcgcattcgctgtgccaacggtggcatccggcttaacaggcacatagctggcgatatagttcagcttgttcgtaccatcaaaccagacagtgtgttcgacaggcgtagagtcggtactggaggggtattgttgctccccaccagatgttttaatttttaacgccacgcccgtcgcgccgccgctatccagggcaaaaagcgaggggtcagtcgggtccggagaaccgtccatcgtaacgctggcctttgtggcatacgcgcaatcttttaagccgatgctaaagtttttctggttcagctctttacccacttttaccgggcgctgaagcaccacggtctccatattgacgtcgatactgtcgttttccagttcacaggtagccgccttaatagtaatggtaaagtggatatcaccagcagaaccgatattcgacggtgccgccatcgcggaagcggtaagcagtaaacacgctggcatcaaagcatgaaggtttttcatcctgcttactccacatcaatacgcatggtggcaattccctcgaaatccccggcggccggcaatttgccggtggtactgatagggtaagccgaaatggtcgttgaggcggtacggtgcgtgtcgtcaacaagacccgatacgctcagctcctgattaacactggcgtcatttggcaccaaaattttaccgttagcgccctcaatgacggcaccgatatccgggttgcccatgtcgatggcattcgaatcattagcgtttggcattccctcaatacgcaggaagatctttacgccatcggaaatattggtgcatttaaactgcagctctttggtgaatttcgtggcgttctttgcaacttgtcctttgcgatctttaaaatcagtggccttaaattccccaaacggaatttccagcgtgctgccgctggagagttcacagccctgaggtaccgtaattgaaccactgatatatacagacgacgcaggtatactgccatatacactgggtttctttgtcacaaaaaggtccattattttggtgctaggtataatactttcacccacaaacggatggagaatatagagcgataagtgacctttgccaccggatgtccatattgcatctttactacttgcattttgcgaacactgagagcggttgtttgtcaggttacctacattctcaaacggtgtgttaacgtattctcctcgtccccccgaaatcagtacatcgctcgcaatggcaatattattattgatctggtaataggagcgactctctatattcgtaacaaaggccagaggaaccacagccttaaataaggtgtcatttataagagaggtatcatcagggcattcacaggacatcgcataggttccacctaaattccagctatcgaaatctacgaaggtcgcacccgttgtgttctttgacgtatctgaaactgttttatttatggtggcactgaagatatgtgttccaccttcaggagtacatggtccaaaatctgccgctgccagcgcctgccccgaaaacagcaccgacccgcccaacaggcccgtaaacattatcaactttttcaacataatcgtttccttccctgttaccggcagacggcattcgccatcaccacgccggtattatcctgttgttccggcagcgtaaacgccacgcggcattgctgtgcctggtctttaccccagttcacctgaagggcacctttctccggcatcccgctgatataaagctgaccgtcttcacccacaatgctgctggactcttttgtggtatccagcagcgtggcggtagcaccaaacggcaccgctttgccattggcctgcgtcagattcatcagcacacgatagcccactcgggtatcgaagcgggcacgaacaatcgcgccgcgtgtcggcactacgttgacggaggcggtatccaggtcaacctggttgttcaggctgtcgcttcgcagtgagacttccgtttcacggtacggagtaaggtaaggtacgaccgcattacccatccagtccacttccacaccaccgttgttgatcacgtgcgcgccgcgcgcgcccggcgcggagataatggccatggattcacccagcggttgagaaagagtgataccttcgctatgggctatcacaccgccgcgcaaaccgtagttcacctgctggccgtcacggttgtagttgtaacccaggctggcgctacccacgccgccctggtaatccaggttcacgctgccgctgttacccacgccgttgctgccgtagccttcctgcacactatagttcaggttgtggtcttccagcgcggtgccgctcacccctaactgctggttggttcggccatgctgatcggtcgtgaggtggtagttactccacacgcgtcccagtggaatcgacatggagaatgacagtaaacgatcgctctcatcccactccgggcttttcgtccaggtgtaagcaacgctgtagttcacgcggccaatacggccgttataaccggcattcagcgaacgctgtttaccttcatcgttccagtagtcctgctgcgtgacgttaaaatagaccgagccccaggcgcccagttgctgcgtcacgttgccctgaatctgactacgtttgtggtactggctataagagctgtccgcatcgctgcgcacatccgtcgcttcctggaaggtgtaatagccgctggtcgaatacttgtaacccagcagacggaaatctgtaccgctgttaaagctcttggagtagaggaaacgataagactgaccttccgaattctcctcatttgccagcttgctttttgcctgggttacatcgatggagatcgcgccgatataaccgaagtttttacctaatcctcccgccagcgagtaatagtcgtcagagaagatcgcaccaccgtaaacggtaaagccatacggcaggccgtacatggcatcaagctgcccgaatttcggctcggcgctgttatagttcccggcacggtattccccggcggaaaggctgtatttgagatggccttcacgctggaggagcgccaccgaggagaacggctgaacgaacttctgctcactgccgtccgattctttaatggtgaccgtcaggtcgccgctgtttgaggttggatacaggtcgttaatttcaaacgcacccggctgaacaaacgtacggtaaataacgtagttgttctgctcaacggtaacttcggcgttacttttggcaataccccggatgacgggcgcaaacccgcgctggctgtcaggcagcatctcttcgtcggaagttaactgcacaccgcgcatctgaacgctgtcaaaaatatcaccggcagtggaggtatcccccaacgtcagctgtgatttcagcggtacaatggcacggcttaaggatgtgccaatgttatcccatgtgttgttaccgtcgtttcgcgtccaggtgctatagttacgtaaccgccatgcccccaggttcataccgctgcgcagattcagatagtagctgtcgctgttgtagctggtttcactgtcgtgtgcgtcatagctggcgttgctgccggaaaagttataatccaccagcagggcattcaccccttcgtcccactgcgattctggcaccgtaccgcgcgctgtctgcttcatcgcagcctgcgggaagctcatgatcagggtctggtctgcaaagtcgaaatggctggcggcctggggaataatgtcgtcaaaagcaacacaggcttcaggcggggccattttcagcgccgggaagctatcaatacgcacgcccatatcttcaagctgcacgcggcttaagcacggcaccagggattcacccatttttgcgcgctgcgcctctgtcgctgccttaaactccagggtgcgagactccatttttttttcgttgaccaccaccgagacgcggtatttacctggcaggtgttcagctttattggattcatacattgaaaggtcaacgtgctgatcaatacccggcacatcctccagaaagcgcgggttaaatgttcccgcatacgcggggagcgtacccgctatcatcagcgcaagcgcagactgcgtgaaacgcgaggtcttattgcccagaggaagatgcgtccatgtcatagtaataatcctttaaaacgtgttagttaacgcgctgtgtcaacatgtcgccagcagtgccaaagtcattaataatgttgtatttaacttcgcttaccttgccggtgccggctggcagttcaatattcaatgagccttttgccggaaccattcccgttttttcaatatcacggccgttggcataaaatttattaaacgtcaggttaaaggcagatgggttttccactttgatctggttagcccctgcgctggtgaactgcagtttgttccagccgtccatgctattgcctttcaggcccgccgggcgatagaacagttttaagcgggtacgtacggcgatctgcagtacgtttttagcttccgcgtcttcacttttggcaggaatagcttttacgttaatccaataaacggactcgcgatcctgcggtaacgtgttcgtcgtattaacaatacgtaaaacgttatttttagtcgggcttaatttaaataacggtggagtgatgataaagggcgtctttttattaccgttagcatcatcaatccatgactgaatgagaaattcatccgtggtgcttttattatttaccgtaagagaagcttcctttctactaccgtcataaataacacgcgtgctgcttaatgccacgcctccggcaaaactgttttgagcaatcaacgccagcaccagtgctgtgcaagatatcaaacgtgagcggttcatgattctcttcctgagcctccgctggaaaaaatggcaacgggatttccgttgccattatgattgtctgtattaacgaaaattcgattattcgtaggacaggttgaagtccacttctgcgttaccgtaaccagtggttacagtatcttttgttgcaacgtagttagcggtgtagtacagcacggtctgaccagcagccaacgtagtggtggatttaccggtgttcatttcaacaagcttgttagcgttgtcgtagataccgatgcccacgccagttgccgcacctgcttcagtgttaacagaaaccagtgtcgcatcgtctgtatcaccaacgccattgaagcttacgttaactttggtattagaggtgatgtcacagtcttccagtttgatctggaaaggcttagaagaagacttgtcgccaatggctttgaagatatttttcttaacctgacccagcacaacttcctggttctgggagtcagtagaaacgacgcatggcgcgtcaacgatttcaccggtgaatttaatggtgccgtcaccagattcagcagcgaaagcagaagtggaaactacagcgagagcagacagagcaaaaacaacctttttcattaaaaactccatttatgacggtagataacagaacgcatccttaggattatctgcattctgtgaggaaatggagtgtatagaggtgggtattggatactataattagtatatataaaaataattgttagttaatcttaaaaagaatagaaatcaatatattacaaatggaatgtacataaatgtaattttttattaagaataaattaatataattaatatattatttcttcctattcataaataagttaaatgtcttccttatttattagacgtttttttaactacaattgattaggtatttgtgctaaataaaaaaaagggcaccaaatgggtgcgctgtacgcttggtgttgcatgtgttacgcagacgcttcgctaaccccctcccgctgcggctggcgaatagtggtggaaagtgccagcgagataattaacagcgcaaagataacgcagaaggttagcaccctacttccgccacaagagctgttatcactgcgtttcgattataatttttaagttaaaacctggcgctcacccccaaggtatacaaataatcgctatccgtagcgctattttccgcctgggaaaacgccgcatacgccgccaggtgcgggttaagtaacacgtccgcgcctacggtgacatccagccagtttcccgcctgatttcctgcggtcatacgactcaacccggactgcgctttccagatattctccccaaactgttggttatagctgatttgcgcccagggacggacatcgccgaactgcgagtttacccgccagcctaacgtactgacgctggcgtgccataacggatcggtaaacgctaatgtcgtcgcgctatcgccatattcgttatacattgatgacgtcgaaccgtcgtaatgcagcgccgcgaccggcccagtggtcacgcgtcgggaaagcggaaaattccagcccatactgataccgctggtcgcatcaagcggggtttcatccgccaggctaagcaccggccccaccgtattttgcgtagactgaatacgttcggccagtatgtcgttgtaattcggttggtgatcgctgtcccaggtatagcgttccgtcgtatgccccggagccgcttcagcgatatattcttgttgccaggcatatgtggtattgataaaaaacgagcaggccataaggcccgccagacaacgcaatgtccggcgaccacggcgttttcttacaatcatcaacgcgactccagagtagagccgaattcggcgatattattgtcattgaatgaaggatgtcgggcatcagccctgtattaactattgtccttttagcgggcccgtcaaggcgggttgaaggaaattttcgcggtaaccacaataacgaggaagtctatgcagcgttgcgactgggtcagccaggaccccctttatattgcctatcatgataacgagtggggcgtaccggaaactgacagcagaaagctgtttgaaatgatctgtcttgaaggtcaacaggccggtttatcctggatcaccgtgcttaaaaagagggagaactaccgcgcctgttttcatcagtttgatccggtacgcatcgcagctatgcaggaggaggatgtcgaacacctgctgcagaacacgggcatcatacgacatcgcggtaaaattcaggccattatcagtaacgcccgcgcctggcttgcgatggagcaaaacggcgagtctttcgccgattttgtctggtcattcgttgatggccagccgcagatcacccaggcggccagcctggatgagatccctacctcaacacctgcgtccgatgcgcttgctaaggcattgaaaaaacgcggtttcaagtttgtcggtacgactatctgttactcctttatgcaggcgtgcggactggtcaatgaccatattaccggctgtttttgccatccgggagaaaaacatgattcgcaaatcccagagtgaagacatggcgtctattctggcgctgtggatgaaaagtaccatttatgcccatccctttatcgaagaacgttactggcacgagagcgaagcaattgtacgcgacgtctatttacccgccgcgcaaacctgggtatgggaggaaaatggacaactgaaaggcttcgtcagcgtactggaagcccgttttgtcggggcgctgtttgtcgcccccgacgcgttaagacacggcattggcaaagcgcttctggaatatgtccagcaacgttttcctctgctgagccttgaggtttaccagaaaaatcaatccgccgtaaacttctaccatgcgcttggttttcgtattgaagatagcgcctggcaggaggataccgcccaccccacctggattatgagttggcaggcggatcaaacgccgtaagcggtagcgccgggccggtatatttctcaaaccagaccagcgcggtgttgcccgcacaaccgttccccagccgggaactgggaagatcttttgtcaggacgtttaccgcaccgtttttgcatatgccgcctgcggtaggttcagggtccggccatgcgccttcgtgaatacagatcacgccaggccgaattccgtcggtaacgaccgcgcccgccagaacctgcccgcgatgattccagacgcgtaccgtatcgccatcgacgattccgcgcgttgtcgcatcctgcggatgaatcgtcaccggttcgcgtccggccaccgcataccgctcccgtaacgaactgtagttaagctggctatgcagacggtgcgccggatgcgcggaaagtagctgaacctgccccgcatcggcgttcccgtgccactcatccggcgccagccacatcggatgaccgggacaatccgcataaccatagctggcaatgcgcgcagaatagatttcgattttgccgctggccgtttttagcggatggttatcaggatcgcggcgaaaatccgcgaagcgcacaaactgcgcgttggcgggattttccggcatctccagtaaacggttagcctgccagaatgcggcaaacggcggcagcgtcaccccctggctggcgccacgctgggcggcaatattgtagaaagtctccagccacgccagctcgctttttccttcggtgaaccgagcgtaaccgccggcttcccaccgttcgctcagttcagcaaaaacgtcaaaatcattccgcgcctcccaccggggcgacacgacctgcttcatcggcgccaaatgctgattgctatagtcgccggtcatggttaaatcgttacgctcatagctagtggtcgcaggcagaacaatatccgcgtgtttcgcggcggccgtccagaaacattccgagataacgaccagttccggtttttgccacgcgcgaatcagacggttggtatcctgatgatgggtaaagttcgcgccgcccgcccaccagataaaacgaatatccgggaagcggcgatccatcccattgtgttggtaaaacccaccggggttttccagcgcctcgacaatacgcgccaccggtattttatctaccgcatcgaccccgccagggatgcttccctgcatcgaggctaacacggcggcgcggcgcgtcgggtttccgccgttagcaaaatgataagaaaaaccaaacccgccgccaggcgtaccaatttgccccagcattgcggccagcgtaacgatcatccagtgcttttgctcgccgaactgctgacgctgcattccccagccagccatcaacatggtggtgttatgatgaaatatttctgccagttcgcggattttcaccgcagaaacgccgcaaatttccgccgcccattccgctgttttggccgtaccgtcggtcgtgcccaaaagatagtcggcgaagcggtcataacccgttgtgcagcgggcaaggaacgcttcatcctgccaaccgttttccaccagcgtatgggcgatccccaacattaacgccacatcggtgcccatatgcggggcgatccactccatcttatcgccaaaaaagtcgacgctttccgatcgcatcggatcgatgcagatcaggcgcttgccgctttgtcgcaacgccgcaaaatagtcgagcccctgttcatccgaggcattccaggcaattttcagagtattcagcgggttcgcgctccagagcaccaccacctcgctgtgttccagcaccaccggccagctagtctgctgctggtaaacctcgttgccacccaccacataaggcatgatagcctgcgccgcgccggtggaataatcgccaagatggccggtataccctcccgccagcgccatgtaacgctgcaatagtgtagccgctttatgcaatacgccgttcgaacgccaaccgtaggagccggcgaagatggacgatggcccataactttcgcgaatacgtttgtgctgagcgtggatcagatccagcgcgtcatcccaacttacgcgaacaaactcatcctgcccgcgtatgccttgcggcttatcgggagaagccaggaaccctttacgcaccatcgggaagcgaacccgcgttttactgtgcacctggtcatgcacaacggtttgcagggagttttggtgtgccgtcgggagttcgccatacgaggcaaaaatgcgttctccgtcggtttcaacgcggactggcccccagtgtgcggcggtcaataccgagtgacgcgatggtgcgtgggtcaatgttcgctcctgaattattgggattatttattttgccgatcaatgttacttacaaatttcagagttttccctggaattttcttcatgtgcagacgtcataatcaaccgccacggtcgctgtggtaaaaataaaaaagtgataaggatttaagatgaaaaaacgtgtatttgtgattgctgccatcgtgagcggcgccctggcagtatctggctgcacaacaaacccttacaccggcgaacgcgaagcaggtaaatccggcattggcgcgggtattggatcgctggtcggcgcaggcatcggcgcactctcctcctccaaaaaagatcgcggtaaaggcgcgctgattggcgcggcggctggcgcggcgctgggcggcggcgtgggttactacatggacgtacaggaagcgaaactgcgtgacaaaatgcggggcacaggcgttagcgtgacgcgaagcggcgataatatcattctgaatatgccgaataatgtcaccttcgacagcagcagcgcgacgctgaaaccggcaggcgctaacacgctgaccggcgtggcgatggtgctgaaagagtatcccaagaccgccgtcaatgtggtgggctacaccgacagcaccggtagccacgatctgaatatgcgtctgtcgcaacagcgtgctgactccgtcgccagttcgctgatcacccagggcgttgacgccagccgtatccgtaccagcggaatgggtccggcgaacccgatcgccagcaacagtacggcagaaggtaaagcgcaaaaccgccgcgtcgaaattaccttgagtccattgcagtaaactaccgtaccgggtaaggcggcatgctttacccggcctgcattattccctcgccagaccggatacacctcgcattattcggtattcattcaccatttaccacgatacggctgccgacaacgggaaaatcggctggtcgattattgctaagcgggttaataataagcctgttccggttggcgcatgccgcgcttaccttttgatttacggagagtcgcatgaagccgtccatcattctctacaaaaccctgcctgatgatttgctgcatcgcctggaggcgcattttaccgtcacccaggtaccgaacctgcatccggaaacggtagcgcaacacgcgcaggcatttgccagcgcgcaaggccttctgggcgccagcgaaaccgttaaccgcgcgctgctggaaaaaatgccggcgctacgcgcggcgtcaaccatctcggtgggatacgataatgtcgaggtggacgcccttactgcccgcaaaatagtcctgatgcacacgcctgccgttttgacggaaaccgttgccgatacggtgatggcattgatgctggccactgcccgccgcgtggtggacgtcgcagaacgggttaaggcgggtgaatggacagaaagcattggcccggcgtggtttggcgtcgatgtccatcacaaaacgctcggtatcgttgggatggggcgtatcgggatggcgctggcgcagcgagcgcactttgggtttaccatgccggttctctatcacgcccgtcggcggcatcaggaggcggaagaccggtttaacgcccgctactgcgatctggatacgttgttgcaggaggctgattttgtctgcgtgatcctgccgctaacggcagaaacgcgacatctgtttggcgcaacacagtttgccagaatgaaatcgtccgccatttttattaatgccggacgcggcccggtggtcgatgaaaacgcgctgattgccgcgctgcaaaacggtgaaatatatgcggcaggtctagatgtctttgaacaggaaccgctatctgtggattcgcccctgctgaacatgtctaatgtcgtcgcggtgccgcatattggctcggcaacgcatgagacgcgctacaacatgatggcctgtgcggtggataatttgattgatgcgctgcagggaaaaatagagaagaactgcgtcaatccgcaagcggcgggataacgctacaggcccgataagcgctggcttgcgcttatcgggcagactgtcattactgggtcgcgtttaccgccgccgtccaggcctgattaaacgcctgatgctgcgaggccaacggcccaatcaacgcattatattggctggcctgctgtgaggtcgggaactgaatgccgttcgcgacaaagctcacctgctcgccctgttgcgcaatataatcgcccacttgtaccaactgctgcgtaaagatctgcgccgccgggatcagcggctgcaaagcatctgccggcacggtgactacttttttgtagacctgatcaaacacaggtttcaggtcatcggcctgctttaacgcgccatgcgcggcatcagcctgcagttttgcattctgcaactgttgcgccagcacgcctaacgaaccatttgcctgccgcagcggctcgcgttgcgtcatataatcctgcggaacgcggatggcgttaacgctatcgaccaccgggcgcagaccggaatccatcgcctggtttacctgctgcgagtagccatacagtatcgcgtaatcagacacgaacggaccaaactgttttttctgatcggccgtcagcgttggtaaacgctctccgctacgcattgctgtattctgcaggaaatcgacaaacgctttgcgctgatcgccttctttatcaaaacacccgctcaggctaaacaccattaataacgccacaacaggcgcaaaccagcgagagcaggacttacctgtcgccattgttaatactcctttcacccaaaaatgcgcacaacgacacctgcgtgcctgacggcttacaaggatagtccaggtcaggcttgcaggataccctttccacgcgatcttgtagcggaaaattatgtttatctgcatcaatgcttaatttgttattttattgttaatttttgacctgacactgcgataaaaaacgcggcaagaaagctttccagcggggagtgtaatatttttttaatctttacaattattttctgaaagacggatataccttcctggatcaaattgttagcgtcctaaaagtcgcgtagcgtaaggcatcgaaacgaatcgatagcgcttcctggcggcgcgtcgccccccacccgcaagtttcccgactattcttaagaggcttcgatgcatttcacgatcccgctgtgtgatttacaggagttctcaatggaatataaagatccgatgtttgagctgctgagcagcctggaacaaattgtttttaaagatgaaacgcgaaagatcaccctgacgcaaaaacccaatccttttaccgaatttgaacagttacggagaggaacgggactaaaaacagatgaattcgccagagcgctgggcgtaacggttgccatggttcaggaatgggaatcgaaacgcgaaaaacccacgccagcagagcttaaattaatgcgcctgatacaggcgaacccacgcttaagtaagcaattgatggagtaatttttacccctttctgtttttaacggtcctgcgtaaggaccgttttccccgcccgattactggcctggagaaataaagtaaaataaaagttgcatcgcccgccattacatgagttaatgtgctcaacggtttgacgtacagaccattaaagcagtttagtaaggcaagtcccttcaagagttatccattagatacccctcgtagtgcgcatttccttaacgcttaaaaaatctgtaaagcacgccataacgccgaaaggcacacttattttttaaaaggtaatacactatgtccggtaaaatgactggtatcgtaaaatggttcaacgctgataaaggcttcggctttattactcctgatgacggttctaaagacgtgttcgtacacttctccgctattcagaacgatggttacaaatctctggacgaaggtcagaaagtttccttcaccatcgaaagcggcgctaagggcccggcagctggcaacgtaaccagcctgtaagcttaaaaagctcagcattttgaatccctgcctgatggcggggattttttttattccaattcccccctctcccccagcataactttgcattactttaccctgcgtccctttgacctttcccttaggggaacccctatagtaggcagggagattgttcacaaggaattgaagttatgtcgaaatcatcatggttattacttttgggtttatgcgccagcggctccgcgcttgcggcatcctcagaatccgcttttctggcgcaacatgggctggcgggaaaaacggttgagcagatcgtggatacgattgatcagacgccgcagagccgtcctttgccttactccgcgtcgattaccagtaccgaactcaaattatctgacggagagcagatttatacgctgccgttaggcgacaaattctatctctcttttgcgccctatgaatggcggacacacccctgttttaaccacagcctttccggctgtcagggagaaatgccgaataaaccgttcactgtaaaagtgacagacagtaaaggcgctgtcatcgtacaaaaagagatgcaaagctatcgaaacggatttatcggtgtttggctaccgcgcaatatggaagggacgctggaagtaagctacaacggtaaaacggcgtcacatgccattgccaccagtgatgacagccagacctgtctgacggaattaccattacgttaaaaaaatgcccgataacataatgggttatcgggcctataaaacgccaacaagataaaattaacagagtgccttgagaatgcataacgccacaagaatggcagaggtgggctcactttgtactgaccccaaaaacctggacagattaaccgaggcatcagcgaaagagtccatttaatacatgggctcttttttgtttctggctataactaaataacattgtccgcaatcgaattatccattccgttgctttcttgcatcacgcggattcctgtctcatcaatattttgttcgtcgtattcttcctgaatttaaccttagacattctatcaaattatcgcttatagcgatttgaacataacagtctttgcattctattgagggagcctaaggaacaatgttcgctgctgagtttgtgatgatttgaaaccatggtgaatgtagaaatttttggcttcttcggtaagtgcatgaaccatgattgcacgtacaccaatattctcggcaacccgatagcaacgaagcactgcatcatgaagtaaatcagcaccaagcccttttccatggaatgagagatcgacagcaagacgggcaagtataatgacagggatgggatctggcatgttacgccgaaggttgcctgtcgcttctgtatggttgacgctaccggtggccagagagtaaaaaccggctacttgcttcgtgtctttcttgcacaccacaaatgttctggccgctccgagagcctggtttttgaggcccttttgcttcaaccagtcatcgagcacagcttcaccgctgacgaactcagctacctgatgaaaagcggacaaaggttctggtgctgttacacgtcccactgaggtttccttgccagcagtttttcgataacgggatcatctgcgaccggtgcatcaagcagattgatgaactcctcatattgctcatcgttaaagttaaatacacggcggtcaaggatcactttctcggcagcctggcaggccgtttccagaatgaaatctgtacgtgacttgtgaaggatttccgcagctgcatcaatgagcgcccgctgcgattccttagctctaaggttaagttgaacatctgatttcatgagacaccccttgtatagcatttgctttacaagaatagcacaaccaccatgtatagcaaacggtatacatcaagtcgtcgtttttcattttttgaatactgatgttcgctttgtgccagaagcggaaattgctcattgtagcggtttactgagttcaacaaggcaaaagaacaatgctgcctttctgcaggctgactattatttcgccaaacatttcctcatcagagcattttgtaatgtcactccacggcaaataggaaagcctcgctccactatatgaaagccgtgtcgtagaaagaacacttccgcagccttacttacatttgaagtaagttcactaattccacgctgtctggcttcctcatgaatgcaattcatcagtagtgtccctaccccctgtcttgaataggttcctgatacaaagaaatgatcaatgtatccatttggttgaacatctgcatatccagctatttcaccatccagctctacaacaaaaggttgtaattccttaatgtgattggcccatcgctccaggtcgatatctgctggggcccaagcatcaatttgttcacgtgtgtagtagtgtgatgcgatcgtatgtacagatgagaaaaaaactctgaataacgatatttcatccccattactgaaccttctgattttcataaaacctcattgtgagagttacttgtagaacaatactaatttttgtgaaatagggcgtccgttcctcgctcatagcagacatttgcgtgaccgtatccaccaacgttcaggtttcctgatagcatccctgtacagaccttgttaatttctgcctggatagctctttaggcgctattcaaccgggctgagtccgttaaatttaaggctaattcgtcgggtattgtagtatcgtatgtaatcctcaatagctatcttaagttcatcaatatccttaaatttactggtgtaaaaactttctgattttaaagtcccgaaaaaacattctgcacaggcattatcaaggcagttgcctttgcgggacatactttggatgatgccaaactctcgtaactgatactggtaccatcaatgacggtattgccagccctgatctgaatgaagaaccggattggtacccgcatcaagtctggcagtaccgccagcgttaatgtattcctgaaataattcttgccaatcaatagagataaccgcgtctatgagttacagaattattagcgaatcaactaatactatttatgttataaaaaaacctgcccgagagcaggtttttgtttatttaactgaacgcttattgaagtaacgaaatatccgcaacctgcaggaacagttcgcgtagtttcgacaacagcgtcaggcggttgatacggatatctttctcttccgcgttaaccatgacattttcgaagaattcatccaccggagcgcgcagagcagccagctcaatcaacgcttcctgataacgaccatcggcaaagtacggctgaagcttatcacgcagcacaaccagatgtctggccaactcaatttccgccgcttctttcagtacggaggcgtggacgatatcgttcagcggctcagtggctttcgccaggatgttggagacgcgcttgttcgccgccgccagcgcagaggcttcttccagggtgcggaaatgagacaccgccttcatgcgggcatcaaaatctgccggacgggtcggacgacgcgccagtaccgcctggatagtgtcgacggtgtaaccttcatcctgataccaggcgcggaagcgacccagcataaaatcgatcacatcatcgactacgttggcattggtcagcttgtcgccatacagacgcaccgcttcttcggtcagcgtttgcagatcaagagcgaggttcttctcaacgatgatgcgcagcacgcccagcgcggcacgacgcagcgcaaacgggtctttgtcgcctttcggatgctgaccaataccgaagatacccgccagagtatccatcttatcggcgatcgccagcgcgcaggccaccgggttagacggcaggtcatcaccggcaaagcgtggctgatactgttcgttcagcgccacggccacatcttccgcttcaccatcatggcgcgcgtagtgcatccccatcacgccctgggtgtcggtgaactcgaagaccatgttggtcatcaggtcgcacttggagagcaggcccgcacgagtggcgtggttgacgtcagcgccaatctgaccggcaatccagcccgccagcgcctgaatacggtcggtcttgtcgcgcagcgtgcccagctgttgctggaacagcacggtttgtagacgcggcagatggtcttccagacgttttttacggtcggtattgaagaagaattcagcatctgccagacgcggacgcaccactttctcgttaccggagataatctgggtcggatctttcgactcgatgttggcgacgaagataaagttcggcagcagcttgcccgcgttgtcataaaccgggaaatacttctggtcgcccttcatggtgtacaccagcgcttcggcaggcacggcgaggaatttctcttcgaatttcgccgtcaataccaccggccattccaccagcgaagctacttcttccagcaggctttcgctcaggtcggcattaccgccaatcttacgtgctgcttcttcagcgtccgctttgattttggctttacgcgcttcgtagtcggcaatgactttaccgcgctccagcagaatttgcgggtactggtcagcattgtcgatagtgaactccggctcacccataaagcggtggccgcgaatgacgcggtcagactgaatacccagaatagtcgccggaatgaccttatcgcccaacagcagggtcacggtgtgcaccggacgcacgaagtgtacgtcagacgcgccccagcgcatcagtttcgggatcggtagtttcgccagcgaggtggctaccatgttcggcaccagcgcttcggtactttcgcccttcacgtgggcacgatacagcagccattcgcctttgtcggtcttcagacgctcggcctgatcaacggtgatcccgcagccgcgcgcccagccttctgccgctttgctcggtttgccttcggcgtcaaacgcctgagcaatcgccggaccacgtttttcgacttcgcgatcgggctgagattcagcaagattcgccactttcagcgccagacggcgcggggcggcaaaccattcaacgttaccgtgcgcgaggccggcgttatccagctccgcagtgaagttcgcagcaaaggactcagccaaactgcgcagtgcttttggtggcagctcttcagtgccgatttccaccagaaaagttttctcagacatggccgcctcttacttgtctttgttgcacatcgggaagccgagggcttcacgggaagcataataagcctctgccactgctttggtcagggtgcgaatacgcaaaatgtagcgctgacgttcggtgacggagatagctttacgcgcatccagcaggttgaagctatgggcggctttcagaatacgctcgtaggccggcagcggcagcgggttttccagcgccagcagctgctgggcttctttttcatactgctcgaagcaggtgaataagaaatccacatcggcgtattcaaagttataggtggactgctccacttcgttttgatggaacacgtcgccgtaggtggttttacccagcgggccatcgctccagaccaggtcgtaaacgctgtccacgccctggatatacatcgccagacgttccagaccgtaggtgatttcaccggtcaccggcttgcactccaggccgccgacctgctggaagtaggtgaactgcgtcacttccatgccattcagccacacttcccagccgagtccccaggcgcccagcgtcgggttctcccagttatcttccacgaaacggatatcgtgaatggtcgggtccatacccagctctttcagagaaccgagatacagctcctgaatgttgtccggagacggcttaatcactacctggaactgatagtagtgctgtaagcggttcgggttttcgccgtagcggccatcggtcggacgacgagaaggctgcacataggcagtcgccatcggctctggccccagcgcgcgcaggcaggtcattggatgagaagttcccgcgccgacttccatgtccaatggttgaacaatggtgcagccctggcgagcccagtaatcctgtaaggtcaggatcaagccctggaaggtcctggtatcaaacttttgcatattatttcgtgctggatacgtgtggatttaaaggaaggagccagtatacccgctggatgcgagatatacagtatgaaaccggtttgtttagcgaaaattgccggatttcgcggcatcacacctcaccaggcgcggcttttaccgcatagaaagatgtaaaaactgcccatctgcatcaaaagagcagacaaaactctctttacggaaagtattaccacgcatctcatagctcccctgaaactgttcgaaaccggtaacagcaattttctgtgcgccagtattgtaacgctgcgccgcctgagctttacacaatgcttccatatccagcgtgcgtgttgggctcactttactctgctgggctttttgcgtcggtggaggtgtcgctgtgcatcccaccagagcgatggctatcatcacagaacagaaatacttcattatcatttttattaccgtctggtttgctggtcagtcttattattaaggtttgtgggtagcagacacattgtgcgaatctccttacgccatcacaagatgtagcgtagaaagtcggatttttccagtgagccaccgcgctggaactctattgaaacggaagctgaggaactgatgcagcctaaaattaactggattgataacctgcgagggatcgcctgtttaatggtagtgatgatccatactacaacgtggtacatcaccaacgcccacagcgtcagcccgctaaactgggatattgcgaatgtcctgaattcggcttcgcgcgttagcgttcccctgttttttatgatttcaggctatcttttttttggcgagcgctgcgcgcaaccgcggcattttttacgtatcgccctgtgccttatcttttacagcgttgtcgccctggcttacatttcactttttacttcgatcaacgtcgagctttcgctaaaaaatgtgctgcaaaaacccgtgttttaccacctgtggtttttctttgcgattacggtgatctacctggtatcgccattaatccaggtaaaaaacgtgagcggcaaaatgctcctgatgctgatggtgatcattggtattattgctaacccaaatactgtgccgcaaaaaatcggcggcgttgaatggttgcccatcaatctgtatatcagcggcgacacgttctactacattctctacggtatcctgggccgcgccattggaatgatggagacgcaaaagtcatcgctgacgcttatctgcactgccctgttcatcatcgcggtatttgttatttctcgcggcacattgcatgaattacgctggcgcggaaattttgccgatacctggtatctgtattgcggtcccatggtgtttatttgcgccgtctcactgttcacggtagttaaaaataagctgaatgcgcggacgttacctggactggggcttatctcccgccactcgttgggcatttatggtttccacgcactgattatccatgcgctacgtactaatggtctggagttaaaacgttggccgccgttagacatcgtgtgggtttttgccgcgacggtgacaggaagcctgctactttccatgctgttacagcgtattgataaacggaaatgggttagctaaacgacaatgatggctccggccatcattcatcatcactgtaggaagcgtaaagatcggttccatatatactgacccccagcgccaccagacacagtattttcagcgcgcccgccagcgccaggttaaatacgccgaccgcgaccatgccgatgccaagcaacagcaaagatttgcaacgagaaagcaagcggccatttcccgtgtgttcctggcgaattaagactggaaaaccacacatgacgattgccgcaaaaaaatatcccttttcgcttaatgtatgacagcctggccacagtcccaccaggtataccactgcaccgacaactaacattcccaggccgaatatccgtttcctgcgcgcaacgtgatcgtccatctcactctccttgtggttgtgtgagacacattaagcgaagaaatagcgatgaaaaaggcgcctgctcagcaataatataaaaatcagaaaacacacatacttacttcgatataattcaatagaattaatatttacgggaaatgcctttcagccaaaactgaaaggcattctgacttatgacatcaacggcaacagctgctgataaagtcgacggaaggtttcacgacgttgttgataaaccgcatgacgctgcgcatcaggataatgcgcctgctccagcggcaactgcggcaatacatcggcgagcggggtctgtttattcaccgcaatttgcgccagacgcgccgcgcccagcgctggccctacatcgccgccagtacgataatcaagctgtagcccgctaatatcagatagcatctgacgccagtattcgctgcgcgccccgccgccgataagcgtcacgctggcgggtttgacgccgcaggcgtgaaccacatccataccgtccgccaaagcatatcccacgccctccagtaccgcccgcgccagttccgccgggccatgctgatgggttaaaccaaagaaaacgccttttgcctgcggattattatgcggcgtgcgctcgccggacaggtacggcaaaaaccagatcgaatcggcatgctcatccgcctgctgtgcggcggcaatcagcgccgggacgttctcctgcccggtgagtttagccgcccagtccagacaagaggcggcgctcaacatcacagacattaaatgccagcgttccggcagcgcatggcaaaaactgtgtactgcgctctccggtttactcagaaagccgtcgctgacggcaaaatagacgcccgatgttccgagtgagagcatcgcctgtccggcatcgatcattcctacgccgaccgcgccagccgcattgtcgccgccgcccgccaccacaggtactgctggcattccccatgcgctggccacctccggcagcaacgttccggtaatgtcactaccttcaaataacgctggcatctgctgtcgggttaaatgacaggcgttgagcataacgtcgctccagtcgcgctttttcacgtccagccacatcgttcccgccgcatccgacatatcgctggcaaagacgcctgtcattcgcagccgcagaaaatctttcggcagcagaaccttgtctatctggtagaaaatatccggttcgtggcgctgcacccagactaatttgggcgcggtaaaaccgggcatcatcagattaccggttatcgcacgcgactgcggcacctgtttttccagccaggcgcactcttcgctacagcgtccgtcattccataaaatcgctggtcgcagaacctgctgacggctatcaagcaatgtcgcgccatgcatttgtccggcgatgcccaacgcccggacgccacttaacgactgttgccgacctaaacctttaaccgcacgatccgtcgcctgccaccactgctctggttcctgttccgaccataagggatgcggacgcgatacggtcagtttttcagtatgcgtagccagcacatcgccctgctcattcaacaggatagcttttacacccgatgtaccaagatcgatcccgatatacatagtgtgggttcctttactgaaagcgcccggcagcgctacgcttaccgggctaatcacgactacaggccgggctaacgcggagtcgcccggtagatagggttatttatcaaacagataacggttaaccagattttctaacagctcctgatgaccgctttgatgtactggcgccagattatgctgctccgcatactgcgccagttcgcctaaggagagttgtcctttcagaatctgctgacccagctcgccattccagccggcatagcgcttcgccacgcgtttatccagctcgccgtcttcaaccatacgcgcggcgattttcagcgacaacgccatcgtatccatcgcgccgatatgaccgtagaacagatcgtatttatcggtgctctggcgacgaactttggcgtcgaagttgagaccgcccgtcgtgaatccgcccgctttcaggatttcgtacatcaccagcgcgttctcttcaacgctaatcgggaactgatcggtatcccagcccagttgcgcatcgccgcggttggcgtcaacggagccaaaaatacccagcgcgatagcggttgcgatttcatggtggaacgaatggcccgccagcgtcgcgtggttcgcctcaatgttcactttgatctctttttccaggccgaactgtttgaggaagccatagaccgttgcaacgtcataatcatactgatgttttgtcggttcctgcggtttcggttcaatcagcagtgtgccctggaaacccattttatgtttgtgctcgaccaccatttgcataaagcggccaatctgttcgcgttcctggcgcagatcggtattcagcaacgtttcataaccttcgcgcccgccccacaggacgtaattttcgccgcccagtttatgcgtggcgttcattgccgtaaccacttgcgtcgctgcccagctaaagacttccggatccgggttagtggcggcgcctgcgccatagcgcgggttggtaaagcagttcgccgttccccacagcagttttacgccgctctgctcctgtttcgccgccagcacatccaccatctgcgcgaagttgtttttatattctttcaacgacgcgccttccggcgacacatccacgtcatggaagcagtaaaaaggcacattcagtttgtggaaaaattcaaacgccacatccgctttgcgtttcgccagctccagcgcttcgcccggttgctgccacggacgattaaacgcgcctacaccaaacatatccgcgccgttccagcagaaggtatgccagtaacaggccgcgaaacgcaggtgatcttccatacgtttacctaaaaccagctcgtcgggattgtaatgacgaaatgccagcgggttagtcgattgagggccttcatagcgaacacgatcgagttggtcaaaataagcctgcatagtgagctccataatcagataagacggcaagtaaacgacataacgtcatactggaatttcctgatttattgctcaattacgttatttcacaccgctattaagagaatccccaaatgtgctctggctctcaaaaaaacgctgaaaaccacagaagaaaaaagcgatcgcgatcgaatcctggcaaataaacaaaaaaccgtaatatatagataagaaatgacaattgtcatccgccgtttgctgtgatgaatttcgcataacgtttcaggcgcaaaataatttgtcatcattcgccagaccgttatgtcagccgttttgatagtatccatgagtccaggttcacttttgcaggatatatcctcatgtttgataaacgtcaccgtatcactctgttatttaacgcgaataaagcctatgaccgtcaggtagtggagggggtgggtgaatatttacaagcctcgcaatccgaatgggatatatttattgaggaagatttccgtgcccgtatcgataacattaaagagtggttaggcgacggcgttattgccgattacgatgatgacgatatcgcgcaattattggccgatgtcgacgtacccattgtcggggtcggcggttcttaccatcttgctgaaaattatcctgccgttcattacatcgccaccgataatcatgcgctcgttgaaagcgctttcctgcatttaaaagaaaaaggcgttaaccgcttcgcgttttacggtttgcccaactccagccgcaaacattgggcggcggaacgggaatacgcctttcgccagctggtcgccgaggaaaaataccgcggcgtagtctatcaggggctggaaaccgcgccggaaaactggcagcacgcgcaaaatcgcctcgccgactggcttcagacgctgccgccgcaaaccggcatcattgccgtaacggatgcccgcgcccgtcacgtattgcaggcctgcgaacacctgcatattccggtgccggaaaaactttgcgttatcggtattgataacgaagagttaacccgttacctgtcgcgcgtcgcgctttcctccgtcgcgcagggggcgcggcaaatgggctatcaggcggcgaagctgctgcaccgtttgctggcgcgtgaagagatgcctttacagcgcattctggtgccgccggtgcgcgtcattgcgcgccgctcgacagactatcgctccctgaccgatccggcggttatccaggcgatgcactttattcgtaaccatgcctgtaagggcattaaagtcgagcaggtgctggacgcggttgggatttcacgttcaaacctggaaaaacgttttaaggaagaagttggcgagacgatacatgcgctgatccacgccgaaaagctggaaaaagcgcgtagtttgttgatttctaccacgttggcgataaacgaaatttcgcaaatgtgcggctacccgtcgctgcaatatttctattcggtgtttaaaaaggagtacgtcactacgccgaaggagtatcgcgaccagcatagtgaagcgttgttgtagtttatccagcctacagatgccttgtaagccggatagcgtagcgccatccggcacacagaattacatatgcgcggcgatcagacgctggttgtcctggtacatcgcgaacaagtagttgttatagcgcgacccctgggtagagtaacccttcagcttatgaatcatcgccgtggcggtgacttcctgatccgccttacgcagttgggcgcgcgacttgcggaaagaagaataagccggatgcgtgttcaggttggcgacatacgcgctcaccgactcctcaaccgacgcgaattgcgagtaacctttcaccttacccggcgtattggtacaacgccctttcgtgcacttcatgccgaacaggttattgttgctacgcgccagtttagaggttccccagccgctttccgccgccgccatcgtcgccaccatgctggttgggataatgtcgacgcgctccagcaacgtattccacggaatacgacgcgtgttgccggaccagctcactttatagcgcttcgcgatatctttcatacgcgcgcgttcagacggcgaccagcggttctggtactgttttgagatcagccaattacggtccgcggtaatcgcggcattttggctggtgatgtaaggcataacggtccggagaaacgctttttttctgggggttccggaagggtattttcgcaaatcaggaagtgaactgctctttgcactattgcgagaatactcttgtttactgctaacctgtttataacttgtctcagttatgtgggacttttgactcgtttgtgttgcgtgcgtctttgccagcacctcacccgaaaatgcgatggtgagtaacataagaatcattgccccatatcgtcgcatgggagtcaatatcattaggtctcctggtcggattgatacattccaacaccttttatttttcacgaagttgaggtttgaaccccaaattctagcaaaaataggcttaaaaagcacctcagggaatagtcttaatccgaaactatgtcaagtattaacgataacaggcagcaataatgccaataaaatgtggtgcttatcgcaaatagaggcgtttttttgcgcctcgtcgctcaccctcgcgtctcctcctgcgcgactctctgctgaggaggagttcattcgcctaaaaaccaggcaagctgatgaatattgcccacaaaggatagcgtgatgaaacttgccgccttcgctctgacgctgatacccggtatcgcgatcgcctcatcatggacctcacccggttttccgacgttctcgacgcaggaaaccgggcgctttaccagccatgctgcattaacaaaaggtacacgcgcgttaacgctccatattgaccagcagtgctggcagccctccggcgccataaaactcaaccaaatgttgtcgttaaaaccctgcgaaggcgcgccgccgcaatggcgtttgtttaaagatggcgactatacgataacggtagatacccgctccggtacgccgaccctgttgttatcgataaaaactgaacctgaacgcaccgcgcagctcgcctaccagtgtcccgtctgggatgggtcgccgctcacgctggatgttcgccaaacctttccggaagggacggtagtgcgcgattattacagtggtcaaaccgataccgtccaaaacgggcaaatcacgctgcaacctgccgacagccacgggcttttattgctggaacgcgcggaaacccatgcgccggcgccttttaactggcgcaacgccaccgtttattttgtgcttacggatcgctttcgcaatggcgatccaaccaacgaccacagctatagtcgccataaggatggtatgcaagagattggcactttccacggcggcgatttgcgcgggttgacgagtcaactggactatctacagcaattaggcgtgaacgccttgtggataagctcgccgtttgaacagatccacggctgggtcggcggcgggacaaaaggcgattttcctcattacgcctatcacggctattacactcaagactggacgacgctggatgccaatatgggcagcgaagccgatctccgcgcgctggtcgacggcgcgcaccagcgcggcatccgtattttatttgacgtagtaatgaatcatgccggttacgccacgctggcggatatgcaggagtatcagttcggcgcgctctatttatccggcgcggaacggcaaaaaattctcggcgatcgctggacaaactggcgacccgccgccggacaaagctggcacagctttaacgactacatcaacttcagcgacagcgccgcctgggaaaaatggtgggggaaaaagtggattcgtaccgatattggcgactacgacagtccgggatttgacgatttaaccctgtcgctggccttcctgccggatataaaaacggaatctaccacgccttccggtctacccgcgttctatgccaacaaacccgatactaaagcaaagttcattgagggctatacgccacgggattatctgactcactggttaagccagtgggtacatgattacggcattgacgggttccgggtcgatactgccaaaaacgttgagcttcctgcctggcaacagctaaaaacccaggccagcgcggcgttacgtgaatggaagcaggccaatccggacaaagcgctggataatagcccgttctggatgactggcgaagcgtggggccacggcgtcatgaaaagtgattattatcgctatggtttcgacgcgatgatcaattttgattatcaggagcaggcggcgaaagcggtcgattgcctggcggaaatggggccagtctggcagcagatgacggataaaatgcaggatttcaacgtattaagttacctctcctcgcatgatacgcgccttttccgtgagggcggtgataaggcggcggaactgctgctgctttcgccaggcgcggtgcagatcttttacggcgatgaatccgctcgtcccttcggccccaccggctccgacccgctgcaaggcacccgttcagatatgaactggcaggacgtgagcggaaagtcagccgcagccgtcgcgcactggcagcgtattagccagttccgcgccagacatcccgccatcggcgcaggccaacaaaccacgctgacgctaaaacacgggtacggttttgtacgccagtacggcgacgatacggtgatggtcgtctgggcgggccgccgctaatcgtggcgctaccggtctcctcgcgtaccggtagccccttcaaaacaaaaaactaacctgataaaaatttgtagcataaaacatcaacaccaccgcctgacccccatttgcgccccgccatttgtagcgttatggttatccactttgacagacagttcgatagatcacccgttatgacattttcacttttcggcgataaatttacccgccattcaggcattacccgcctgatggaggatctcaacgacggcttacgcacgccaggcgccatcatgcttggcggcggtaacccggcacacatccctgcaatgcaggattatttccagacgctactgacagatatggtagaaagcggcaaagccgctgatgcgctttgtaattatgacggtccccagggaaaaacggcgctactgaatgcactggccgtactgctacgtgaaacgctgggatgggatatcgaaccacagaatattgcgctgacaaatggcagtcagagcgcgtttttctacttatttaatctcttcgccggacgtcgcgccgacggcagtacgaaaaaggtactattcccgcttgcgccggaatacatcggctatgcagattccggtctggaagacgacctcttcgtttcggcgcggccgaatattgaactgctgccggaaggccagtttaagtatcacgtcgattttgagcatctgcacatcggcgaagaaacggggatgatttgcgtctcgcgcccaaccaacccaaccggtaacgttatcaccgacgaagagctgatgaagctggacagactggcgaatcagcacaacatcccactggtgattgataacgcttacggtgtaccgtttccgggcattatctttagcgaggcgcgcccgctgtggaaccccaatattatcctatgcatgagcctctcgaagctggggctgcccggttcccgctgcgggattatcatcgccaatgataagacgattaccgccattgccaacatgaacggcatcatcagccttgcgcccgggggcatgggcccggcgatgatgtgcgaaatgattaagcgtaacgatctgctgcggctgtcggaaacggttatcaaacctttctactatcagcgcgttcaacagacgatcgcgatcattcgtcgctatttatccgaagaacgctgcctgattcataaaccagaaggcgcaatatttttgtggctgtggtttaaagatctgccgattaccaccgagttactctatcaacgcttgaaagcgcgcggcgtgctgatggtgccgggccactatttctttcccggactggataaaccctggccgcacacacaccagtgtatgcggatgaactacgtgcctgaaccggacaaaatcgaggcgggcgtaaaaattctggcagaagagatagaacgcgcctggcgtgaaggctgacggttattccggccatcatgcaggccggaacgacgttcagaaaggttgagaatagaggcgctggcgctgcacgtgtgctgcgtcaacgcactgtaacgcactggtcgggcaggcttccacgcacgccggccccgcttcccgatgccagcaaagatcgcatttaatcgcctgcgcgcctgacgcggacgccaccacagtcatcgcgccaaacgggcaagccagcatacagcttttacaaccaatgcagcgcgatgacgtcacgaagatatgcccccgatcacggcgaatcgcctgtaccgggcagacatttgcgcacggcgcgtcctcacactgatggcagaccgtggccgtggtgaagctatcctcttttatcacccggatacgcggcacaaagtccgccgtcgtcaccgccgcgctattctgctgttcctggtgcgacaccacgcaggcgacctcgcaggtacgacacccgatacacgccgacgcatccgccataataaaccggttcattgttctccccctgcgttaaaacgccagaatgccagagagccattccccgccgctttgatcccactacgcaaacggacaaattttgtcagatgcctgataaaacctggcgagctgtcttattcgcgaacggtaaatcccagctcgttagagatagcctgtgcggtttcacgcaacggtttgagcagatttttctcgccgatctgttttagccgtgacgtcgacagtgaaatagaaatggcgtaaggcactcgatggtgaatatcaaacacaggcacagcaatacaggaaacgcctagttcattttcttcgcgatccatcgccatgctggtttcacgaatttgcgccagctcatcgtacattgctggtaaatcggtaatggtattacgagtcagcggctggatctgatctttatggctttcccagtaagacgccacataatccggctgaccaaacgccatataaattttccccatcgccgagcagtacagcggcatatgctggccaatgtaggcacgcgtgcgcagcataccggtggtcggttccagcttataaatcaggatagcgtggtcatcttcacggctggaaaaattcaccgtctcgccggtggtcaggttgagcgcctcaaggtgcggtgccgcaacgtggatgatattcagcgatgacagggctttttggccgacggcaataaactttgtcgtcagacggtagctcccggccgccggcgctggcgtcacatatccgcaggattgaagcccctgcaacaaacgatggacggtactcttgttcagccccgccagctccgacaggtgcgccagcgggcaaccgttcgggtagttactcaaaatttctatcaacatcaggccacgaaacaggctctgactccccgcaggcttctctttatcgttgttctggctcatcagaaaactctctcctttcttgggcgatcagatggtagctcaaagtgtgttgcagttcacgatatcagcataaaaaacataacccgatgattttaatcatttttaaaaaccttctctggcgttgccatgtcaatttttgatctatatatttggaactagatttcgcattatgaaatttatagacaaaaaaacatactaaaatttctaacaatcgaccaggagaacagggatgaaagtaactttcgaagagttaaaaggggccttctaccgcgtcttgcggtcgcggaatattgcggaagataccgccgacgagtgcgcggaaatgttcgctcgcaccaccgagtccggtgtctattcccacggcgtgaaccgctttcctcgcttcatccagcaactggataacggcgacattattcctgatgctaaaccgcagcgggttaccagcctcggcgccatcgaacagtgggatgctcagcgcgctatcggcaacctgacggcgaaaaagatgatggaccgggccatcgagctggcttccgatcatggtattggcctggtggcgttacgtaatgctaaccactggatgcgcggcggcagctacggctggcaggcggcggaaaaaggctatatcggcatttgctggaccaactccatcgccgtcatgccgccgtggggggcgaaagagtgccgtatcggtaccaatccgctgatcgtcgccatcccgtctacgccgatcacgatggtagatatgtcgatgtcgatgttctcctacggaatgttagaagttaaccgtctggcgggccgcgaactgccggtggacggcggtttcgacgataacggtcagttgaccaaagaaccgggcgttatcgagaaaaatcgccgcattttaccgatgggttactggaaaggatctggtctgtcgattgtgctggacatgattgccaccctgctttccaacggctcttccgttgccgaagtgacccaggaaaacagcgatgaatatggcgtctcgcagattttcatcgccatagaagtggataagctgatcgatggcgcaacccgcgacgccaaactgcagcggattatggatttcatcaccaccgctgaacgcgccgacgacaacgtcgcgattcggctgcccggccacgaatttaccaaactgctggatgacaaccgccgtcacggtatcaccattgacgacagcgtctgggctaaaattcaggcgctgtaaggagccacatcatgatttttggacatatcgcgcagcctgatccgtgccggttaccgtcggccatagagcaggcgctcgatttcctgcgtaatacggactttcgcacgctggaacctggcgtagtggaaatcgacggcaaaaatatcttcgcgcagattatcgatatgaccacccgcgatgctgctgaaaatcgtccggaagtccatcgccgctatctggatattcagtttctggcatggggtgaagagaaaattggggttgccattgataccggtaataatcaaatcagcgagtcattattagaacagcgcgatattattttttatcacgacagtgaacatgaatcattcattgaaatgataccgggaagttatgccctgtttttcccgcaggatgttcatcgtccaggttgtaataaaagcattgctacgccgatacggaaaatagtcgtaaaagtcgccatagacgttttataaaatagagtttactggagcacaaaatgaaaaataataccggttatattatcggtgcgtacccttgtgcaccctcatttcaccagaagagtgaagaggaagagacggaattctggcggcaactctctgatactccggatatccgggggctggagcagccttgtcttgaacatcttcacccgctcggcgacgagtggttattgcgccatacaccagggaactggcaaatcgtggtcaccgcgataatggaaaccatgcgccgccgtagcgaaaacggcggttttggattagcgtccagtgacgaggaacagcgtaaagcctgcgtggaatactaccgtcatctttatcagaagatcaataaaatcaatgggaacaataccggcaaagtcatagcccttgagcttcatgccgccccgctggcgggcaatccgaacgtggcgcaggcaaccgacgcctttgcgcgctcattaaaagagattgccaactgggactggtcctgcgacctggtgcttgaacactgcgacgcgatgaccggccccgcaccgcgcaaaggattcttaccgttggtaaacgtactggaaactattgccgactatgacataagcgtctgcattaactgggcgcgctcggctattgaagggcgggatacctctctaccgctgatccacacgcagcaggccaaacaggctggaaaactcggggcactgatgttctccggtacaacgctggatggagaatacggcgaatggcaggacctccatgctccgtttgcacctttctgtccacaaagtctgatgacggagaaacatgttaaagaactgattaccgccgccgctcccgaactgttgcagtttaccggtattaaattgttggaaatcaatgccagtgccgatattaatcaccgcataaatatattacgcgatggtattaacatgatgaaaaaggccacacgccgctaacctgaattaaacatcatcaccttaattctcggcctgcaactcaacgttgcgccgacctaatataaaccaaacataagaaattaagttccactattcagcatcgaaagaaataagtttctataacctgatggagtcgttatgaagcgggtacttgagggcatacttgcggtattaattgccgtactttcctgcattgtatttattaacgttattttacgttacggttttgagagcagtattttgtcggtagatgaactatcacgttatctatttgtatggctgacgtttattggcgccatcgttgcatttatggataacgctcacgttcaggtcacttttgtggtggaaaaactttcgccagcgaatcagcgtcgtctctcgctgctgacgcattcgctgattttattgttatgcatcgcattaggctggggcagcctgcaaaaagcgttgcaggactggagcgatcactcgccaatcctcggtttaccgatcggcctgatgtatatcgcctgtctgcccacaagcgttgccatcgcgttaatcgagctgcgtcggctttatcacttaataacgcgtaacgattcctttcaacaaccacagcaaggagcctaatcatggccgtggtgatatttctctgctgcctgctcggcgggatcgcgataggtttacccatcgcctggtcgctgctgctttgcggcgctgctctgatggcatacctggatatgtttgacgtgcagattatggcgcaaaccctggttaacggcgcggacagtttctccctactggccattcccttttttgttttggccggtgaaatcatgaacgcgggcggcctgtcaaagcgaattgtcgacctgccgatgaagctggtcggccataagcccggcggcctgggctacgtgggcgttattgcggcaatgattatggccagcctttccggctctgcggtagcagataccgctgcggtcgccgcgctgctggtgccgatgatgcgctccgcaaactacccgatcaaccgctccgttgggttaatcgcttccggcgggatcattgcgccaattattcccccctcgattccttttattatcttcggcgtttccagcggcttgtcgatcagcaagctgtttatggccgggatcgcaccgggcatcatgatgggcgcggcgcttatgctcacctggtggtggcaggccgggcgattaaatctcccttctcagcctaaagcaacaccgcgtgaaatctggcaatcattggtttcaggtatctgggcgctgtttttaccggtgattatcatcggcggcttccgttccggacttttcacgccaacggaggcaggggcggtcgccgcgttttacgccctctttgtcgccgtggttatctatcgggaattaacgttttccagtctctaccacgtgctggtcaatgccgccaaaacgacgtcagtcgtcatgtttctggtggctgcggcccaggtatccgcctggctgattacgatcgcggaattacccatgatggtgtcagatttgctgcagccgctggtcgactctccgcgactcttatttatcgtcattatgatctcaattatggtcgtcggtatggtgatggatttgacgccaacggtgttaattcttacccctgtattattgccattagttaaagaagccaatattgacccgatttatttcggcgtcatgttcattattaactgctctattggattaatcacaccgcccgttggcaacgtcctcaacgttatttccggggtagcaaaattgaaatttgatgacgcggtaagaggcgtattcccttacgttgtcgtcctgatgtcgctgctggttttatttatttttattcccgagctaattatcacaccgcttaaatggattaattaaaggataatattatgaaattacacgttattgctcgttcattattgatagctggtctgacggttttcagcgtgtcgtctctggcggcgcaatctttacgttttggttatgaaacaccgcaaactgactcccaacatattgccgcgaaaaaatttaacgaactattaaaagaaaaaactaacggcgaattaacgctaaaactctttcctgacagcacattaggtaacgcccaggcaatgatcagcggggtgcgcggcggaaccattgatatggaaatgtccggttcgaacaatttcaccggcctggcccctgtattcaacttacttgatgtccccttcctgtttcgcgataccgcgcatgcgcataaaacgctcgacggcaaagtcggcgatgaactgaaaaaatcactcgattcaaaagggttaaaagtgctggcctactgggaaaacggctggcgcgacgtcaccaactcccgcgcgccggtaaaaacgccgggcgatttgaaaggcttaaaaatccgcactaacaacagcccaatgaatatcgcggcctttaaaatcttcggcgcgaaccctattccgatgccattctccgaagtctataccggcctcgaaacccgtacgattgatgcccaggaacaccctatcaacgtcgtgtggtcagcgaaattctatgaggtacagaaatacctctccctcactcatcacgcctattcgcctctgctgctggtgatcaataaagccaaattcgacgctttaagcccgcagttccaggaggcactgctgagttccgccaaagaagcgggtgactatcagcgcaaactggtcgccgaagatcagcaaaaaattatcgatggcatgaaagaagccgaagttgaagtcctgaccgatatcgaccgtaaagccttcagcgatgcgctgggcagccaggtgcgcgatatgttcctgaaagacaacccgcagggcgccgatctcctgaaagccgtggacgaggtgcaataagtcatgagcaactactggctggggttagattgtggtgggagttggctaaaagccgggttgtacgatggcgcaggccgggaagtagcggtgcaacgcctgccgctgcacgctttaagcccgcagccaggctgggttgaacgcgatatgaccgagctgtggcaacagtgcgcctcggtcatcagcaaactgctggcgcacacgggggtgagcggctcacaaatccgcggtctgggtatttccgctcagggtaagggcctgttcctgttagataaaagcgatcggccattaggtaaagcgatactctcttccgaccgtcgcgccatggaaattgtccagcgctggcaaaaagaagcggttccgcaaaaactctacccgctgacccggcaaaccctgtggaccgggcatccagtctcccttttacgctgggtaaaagagaatgagccgcagcgctacgcgcagataggctgcgtcatgatgacgcatgactatctgcgctggtgcttaaccggcgtgaaaggctgtgaggagagcaacatctccgagtccaacctctacaacatggcgacgggccagtacgacccgcgtctgaccgagtggctgggcatcagtgaaatcgacagcgcgctgtcccccgtggtgggttcagccgaaatatgcggggagatcaccgctcaggcagccgccatcaccggtctggcggcgggtacccccgtcgtcggcggcctgtttgatgtggtttccaccgccctttgcgccggtattgaggatgaatcgaccctcaatgcggtgatgggcacctgggccgtcaccagcggcatcgctcacggcctgcgcgaccatgaggcccacccttacgtctatggccgctacgtcaatgacgggcagtatatcgttcacgaagccagcccgacctcctccggcaaccttgaatggtttaccgcccagtggggcgacctctcttttgacgagatcaatcaggcggtcgccagcctgccgaaagccggtagcgaccttttttttctgccgtttctctacggcagcaatgccggactggagatgacctgcggtttttacggcatgcaggcgctgcacaaccgcgcgcacctgctacaggcgctctatgaaggcgtggtcttcagccatatgacccacctcaaccgcatgcgtgaacgctttaccgaggtttgcgccctgcgcgttaccggcggcccggcccactccgacgtctggatgcagatgctggcggacgtcagcggtttacgcattgagctgccgcaggtggaggagaccggctgcttcggcgcggcgctggctgcccgcgtcggcaccggcgtatatcgcgatttccgcgaggcccaacgcgacctgcagcacccggtgcgcacgctgctgccggacatgaccgcgcacgccctctaccagcgcaaataccgccaataccaggatttgattgaagcactacagggctatcacgcccgtattaaggagcacgcattatgagccgaccattactgcaactggcgctcgaccacaccagtctggaagcagcccaacgcgatgtcgccctgctacaggatcatgtcgatatcgttgaggccggaaccatcctttgtttaaccgaaggccttagcgcggtgaaagccctgcgagcgcagtgcccggaaaaaatcatcgtcgccgactggaaagtggccgatgccggtgaaaccctggcgcagcaggcttttggcgctggcgctaactggatgactatcatctgcgccgcgccgctcgcgaccgtcgagaaaggccatgccgtcgcgcaatcctgcggcggtgaaattcaaatggagctgttcggcaactggacgctggacgacgcccgagactggtatcgcaccggcgtgcgtcaggcgatttatcatcgcggacgcgatgcgcaggccagcgggcaacagtggggagaagcggacctggcacgcatgaaggcgttgtccgacatcggccttgaactatcgattaccggcggcattaccccagcggatctgccgctgttccgcgacattaacgttaaggcatttatcgccggacgtgcgctggcaggtgccgcccatccggcgcaggtcgccgccgaattccacgcccaaattgacgccatttggggagaaaagcatgcgtaatcatccattaggtatttacgagaaagcactggcgaaagacctcagttggccagagcggctggtgctggcaaaaagctgcggttttgattttgtcgagatgtcggtggatgaaaccgacgaacgcctttctcgcctggagtggacgccagcccaacgcgcatcgctggtgaacgcgatgctggaaagcggcgtcgctatcccgtcaatgtgtctctccgcccatcgccgtttcccttttggcagccgcgacgaagcggtacgccagcgggcgcgtgaaatcatgaccaaagccattcgcctggcgcgcgacctggggatccgcaccatccagttggcaggttacgacgtctattacgaagagcacgacgaaggcacccagcaacgtttcgccgaagggctggcgtgggcggtggaacaggccgcagcggcgcaggtgatgctggcggtggagatcatggataccgcgtttatgaactccatcagcaagtggaaaaagtgggacgagatgctttcgtcaccgtggttcaccgtttatccagacgtcggcaacctcagcgcctgggggaacgacgtgaccgccgagctgaagctgggtattgaccgtatcgccgctatccacctgaaagacacgctgccggtgaccggtgacagccccggccagttccgcgacgtgccgtttggcgaaggatgcgttgattttgtcggcatcttcaaaacgctgcatgagctgaattatcgcggttcatttctgattgagatgtggacagagaaagccagcgagccggtgctggaaattatccaggcccgacgctggattgaatcacggatgcaggaaggaggtttcacatgttagagcaactgaaagccgaggtgctggcggccaacctggccctcccggcgcacgggctggtcacctttacctggggcaacgtcagcgcggtcgatgagacgcgcaaactgatggtcatcaagccttccggcgttgaatatgaggtgatgaccgccgacgatatggtggtggtagagatcgccagcggtaaggtcgttgaaggccataaaaaaccgtcgtccgataccgcgacccatctggcgctctatcgccgctatccgcagatcggtgggatcgtgcatacccattcccgccatgcgacgatctggtcgcaggccgggctcgatctgcccgcctggggcaccacccacgccgactatttctatggcgcgatcccctgtacccggctgatgaccgttgaggaaattaacggcgagtacgagtatcagaccggcgaggtgattattaaaacctttgaagagcgcggtctcgatccggcgcaaatcccggcggtattggttcattcgcacggcccgtttgcctggggtaaaaatgccgccgatgccgtccacaacgccgtggtgcttgaggagtgtgcctatatggggctgttctcgcgccagctggccccgcagctaccggatatgcagcctgaactgctcgataaacactatctgcgtaaacacggcgcgaatgcctattacgggcagtaatgccggcagccacagcctgtgtcagatggcggctgcgccttatccgacctacaagatttgcaatatcaatacgttgtgatgaactcttgtaggcccgataagcaaagcgccatcgggcattcagtttgcaaccgctttgtcagagggccaaagattatactcaagaattaacgtgttccttactgtagcgccgcttccaggcggtaggcgtcaggccggtgtgcttgcggaagatctggcgaaagtaaccaacgtcattaaaaccgcaccgttccgccacctcttttaacgaacgcgcgtcgctaatcagcaacttttccgcctcgcgcacccgctggcggtggatggcttccgttagcgtaaggtgaaatacccgccgataaacgcgtcccagataatccacattgcaatgcagttctttcgccagaaccgcgctggaaagcggcaggtgatagtgcgttcgaatcagctgctgcgctttccaggccagcgacacgccagcggcctcggcgttttcattctgccgggcgtcaacggtgagctgctgcaaaatcagcagcacgatgaactccagcgccgggctgcgctggtgcttttcctgctcgttcataaactggcgaaaaagcgcaatcagcgcctgcggatcggcaacctgggtatgctgcggcacggaaagatgcgtcagccagcgcgggtcgctgtccggcgctttgacctcaaaatggagccagtaaaatttaagatcggcgggaaactcctcaacgccaatatggcggcgatgcggccaaagcaacaggctttccccggcttcgacacagaaaacacattcttcttcctgaattttcaggcagcctttttccacaaatataatttcccacgattgcagacgcctggctggatgacgcccaataccgcgagaaataaataatccgccgttttggactttaatcggtaatgttatggataattcgagcattaatatgtcatttcccgctcattcagcaccgtatttcatattagcttttgattattaactaaaaatagtcatttcactcgatccatctcacatttttaaatgcgggtcggaatcgtcatctttttttactcttttatcgccttgtcgctcaccgctatctgggcaaaatgaatcaggtcataacgcgaaaataaaaattactgccataaaataccccgtcagcgaggaatatctatgacctctacagccttaaggagcacgaaatgaacgtactggaagtcgatctgcataaactgacggtcagcgatccgttcctcggacagtatcaacaactggttcgcgatgtggttattccttaccagtgggatgcgttaaacgatcgtattccagaggctgaacccagccatgccattgaaaatttccgcattgccgcaggccagcagacgggcgacttttacggcatggtctttcaggacagcgacgtggcgaaatggctggaagcggttgcctggtcactgtgccagaagcccgatccagcgcttgagaaaaccgccgatgaggtgattgaactggtggccgccgcgcagtgtgacgatggctatctcaatacgtactttacggcaaaagccccgcaagaacgctggagcaacctggcggagtgccatgagctttattgcgccgggcatctgattgaagcgggcgtcgccttctttcaggccaccggcaagcgtcggctgctagacgtcgtttgtcgcctggccgatcatatcgacagcactttcggccctggcgaaaatcagctgcacggctatccgggccacccggaaattgagctggcgctgatgcgtctgtatgaggtaacagagcagccgcgctatatgacgctggcaagctactttatcgggcagcgcggcgcccaaccgcacttctacgacgaagagtacgaaaaacgcggccaaacctcttactggcatacctacggcccggcgtggatggtcaaagacaaagcctacagccaggcgcatctgccaatttcgcagcagcagacggcaatcggccacgcggtacgttttgtctatctgatgactggcgtggcgcatctcgctcgcctgagcaacgatgaaggcaaacgccaggactgcctgcgtctgtggaaaaatatggcgcagcgtcagctgtatatcaccggaggcatcggttcccagagcagcggcgaagcctttagcagcgattacgatttaccgaatgattcggtctatgcggaaagttgcgcttcaatcggcctgatgatgttcgcccgccggatgctggaaatggaagccgatagccagtacgccgacgtgatggagcgcgcgctgtacaacaccgtcctcggtggtatggcgctggatggcaagcatttcttctacgtcaacccgctggaagtgcatccaaaatcgttaaaattcaaccatatttacgatcacgttaagcccatccgccggcgctggtttggctgcgcctgctgcccgccgaacatcgcccgcgtgctcacctcccttggtcactacatctacacgccgcgtgcggatgcgctgtacatcaatatgtacgtgggtaacagcatggaaataccggttgaaaatggcgcgctcaaactgcgaatcagcgggaactacccgtggcatgagcaggtgaagatcgccatcgactctgtgcagccggtacgtcacacgctggcgctacgtctgccggactggtgccctgaggcaaaagtgacgctcaacgggctggatgtggagcaggatattcgcaaaggttatctgcatatccgtcgaacctggcaggagggcgatacgataaccctgacgctgccgatgccggttcgccgcgtgtatggcaatccgctggcgcgtcacgtcgccggtaaggttgccattcagcgcgggccgctggtctattgccttgagcaggccgataacggcgaagagctgcataatctgtggctaccgaaagagagtgagttccgggtctttgagggcaaagggctttttgcgcataagatgctgattcaggctgaaggcgagaagcaaagcgccccagatgcgcagcatcaggcgttgtggcactacgataacgcgccgtcatcgcgccagccgcagacgctaaccttcattccgtggtttagctgggccaaccgtggcgagggcgaaatgcggatttgggttaacgagcggtaatactgtgccggatggcggctgcgccttatccggcctacaatatttgcaatatcagtatattgcgataaattcttgtaggcccgataagcgaagcgccatcgggcattacctcttgcgtcagaacagccccagaggcttatcggaatagctcaccagcaggcacttggtttgctggtagtgttccagcatcatcttatgcgtttcgcgcccgatgcccgactgcttatagccgccgaacgcagcatgtgccggataggcgtgatagcagttggtccatacgcgcccggcctgaatgccgcgccccatcttataggccagattgccgttgcggctccagacgccggcgccgaggccatactgcgtatcgttagcgatttccagcgcctcctccatggttttaaaggtggttaccgccagcactgggccaaagatctcctcctgaaagacgcgcatattgttcttaccaaacagaatggtaggctcaaggtaatagccctctttaagttcgccatccagctccttgcgtcgcccaccggtcagaatatcggccccctcttttttaccgatatcgatataattgaggatagtctcaagctggccgtgggagacctgcgcccccatctgtgtaccgctatctagcgggttcccgctgcgaatgctctccacccggcgaatagcgcgttccataaagcgctcatagatggactcctggaccagcgcacggcttggacaggtacacacctcgccctggttaaaggcaaacagggcaaatccctccagcgctttatcaaagaacgcatcttcctcatccatcacgtcagcaaagaagatattgggcgatttaccgcctaactccagcgtcaccggaataatgttctgcgtggcgtactgcatgatctgttgacccacttccgtcgaaccggtaaacgccaccttcgcgatacgtttcgaggtcgccagatattcgccaatctcgccgcccgcgccgttcacgacgttgacgacgcccggcggtaacagatcgccaatgatttccatcaacagcaaaacggaaagcggcgtcaggcgtgccggtttaagcaccacgcagttacccgccgccagcgctggcgccattttccagcttgccatcaacaacggaaagttccacgggattatctgccccacgacgccaagcggttcgtgaaaatggtaggccacggtttcgctatcaacttcgctaatcccgccctcctgcgcacgtatacaggaggcgaaatagcggaaatgatcgatcgccagcggtacgtcggcggcgctggtttcacgaatcggtttaccgttatcccaggtttccgctgtcgccaacagttcgaggttttgttccatccgatcggcgatcttaaacaagatagcggcacggtcttgtactgacgtatgcgcccacttatctttcgccttatgcgcggcgtcgagcgctaaatcgatatcttttttaccggaggaagcgacttcacatagcggctggccggtcactggcgtcaggttttgataatattcgccgtcggcgggcgcaacccagtcaccaccaataaaattgtcatagcgggcttttaacttcagtgggtacccgtattcacctggctgaatacgtgttgaagggggattgttcgtcatgaccaactccttattgtaaaggtactccacaagggtagacggtgctggtgaatttttcgccaatgatttcccgctttacgacagcaatcacgaattactttcctttacgtttctccgtctggttttagccatactaaacaggtgcctgtttaacgtacggagaacactatgcagcaatatatcggtattgatgtgggaggaactcacgtcaaatatggcgtgattaacagtgacggcgaagaattaacccatcatcaattcgatacgccagaggacgcctccacgtttacccgcaaatggcaggatgtggtggcgcgttgccaacaggactatgacattgcggcaatcggggtcagtttccctggccatattaatccccataacggtcatgcggcaaaagcgggcgcgctggcttacctggatgacgtcaacctgatggagttgttcagcgggctgaccgatctgccgctggtcgtggagaacgacgcgaactgtgcggcgctgggcgaaatgtggcgaggtgccgggcagcattatgaaaacatggtctgcattaccattggaaccggcattggcggcggtattatcgtcggacgagaactgtatcgcggcgcgcattttcacgccggtgaattcggcgtcatgccggtcgggaacaatggcgaaagtatgcataaaatcgcgtcaaccagcggattaatggcgtcgtgccgccaggcgctggcgctgcctgccgaagagatgccgcctgcggatgtgatcttcgaacgaatggcgaccgatgttcatctgcgtgaggcggtcaatgactgggcgcgttatctttcacgcggcgtttacagcgtgatctctatgtttgatccgggcgtggtgctgatcggcggaggaataagcgaacaggaaaagctctacccgctcctgacgcggcatcttgaaacgtttgaaatgtgggaggcgctccaggtgccgattcagccctgccaactgggaaatcaggcgggcaggctgggcgccgtctggctggcgcagcaaaagctcgaccgaggctaacgtgttacgccttatccggcctgcattgtctacgcaggcccggtaagcgtccgcgccaccgggcaaaggcgttacatcgccgtgcgataaagttccacaatctcatcgtgagtcgcctgaataaggcgcaaagaatacgggtgaaattatcctgataacaggttcacgctggctattttaagaagccagaaaaataaaaagcacatctggttcatttcctgatgtgctttttataaagcaacgcaataattgtattgcttcatttgttatttaatttaaccatttcattctttttgcggaaataataacgcatcacgtaataaatgatcattcccacgacgtcgtgtaaatccaatccggtcaaaatattcaaggatctgaatggccagtttccgccctacattcagcctgtcgcgaaaatccgccgcacaggttgatcctctctcttgatccagctcgcggatcatattggcgaaagcgacaatccgatcgttacgatagtaccgatcttttacgatcgcggtaatgatgccttgctgtgccgcctgccgcagcaccagccgcatcaattgttcttccgttccggtctctttcgccagatcgcgtacccaccagggttcatcgccaaatagcggttcgactttttgccagacggcctgctgctcatcgctaaatcccgctttatgatccggcagatgcaaccaaccgtgatggctatgaatcaggccgtcgtcgcgcatccgctcgatcagcatcagaaccagcgcttcatcctccatcggcagggccatgcggcgtaaacgctcgcgtcccggccccggttcatcgcggtgctgttcgtggtaggtcgccagcgtatcaagaatcttacgctgccagcgggcggcgacgggcgcgcttaacaaattgtctccagcctggataaaaccatgttgctcaataagctgacgcataccgagaggattaagctgacgcgcccaaccgaaatccggcaggttgacggcgccgcgttccagatgaatggccaacgccgcgctatcgtcctgcgcggcggcaagcgttgaaagccagtgcaaataatctggcttacgtttaccgcgacgcggcgccttaagcgtcaccacgcgtgcgccggcaagggtggcacgtgcggaaatatcacgcagcaccagtctgtcattatcggccagccacaacggcgtatcaaagatcagctcggccagcccgccttccagcaaagagacgcgaccggtcacatggctggcagcatggtgaatatgtagcggttgccattgggaaagcggcgcatgaagcgccagagaaacgatcacccgggaaaaagcctcccccaccggcgcatcggaaagcagccagtcgccgcggttaagctgctccttctccgcatcgcccgcaatattgagcgcaatacgttgcccggcatacgcatggtcagtgggctgattttgcgcgtgtagacttcgtacgcgcatcggcgtattaacgccggtcaaccatagcgtatcgcccacgtttacctctccgctcagcgccgttccggtcaccaccagtcccgcccctttcaccgtaaacgcacggtcgatagccaggcggaagcgatgctgcgcggcgtgcgaacgtgcaggaagctgctgtaaatgagcgcgaagttctgcaataccgcgtccttcattggcggcggtgacaaataaaacggtatcggcgaagccatagttgtcgagcgccgccagtacctcttcacgtacttcaccgatacgcgcctcgtccacgcgatcggctttggtcagcgcgacggtgagctggagattacccgtcagttgtaggatctgtaaatgctcgcgcgtttgcgccatgacgccgtcatcacaggcgaccaccagcaaagcgtgatcgataccgcctacgcccgccagcatgttagagaggaatttttcatgcccaggcacatcgataaagcccagcacacgaccatccggctgcggccaataggcgtagcccagatcgatagtcatcccgcgttttttctcttccggcaggcgatcggcattgaccccggtaatcgcctggagcaacgtcgttttaccgtggtctacgtgtccggcagttgcaataatcatttcagcatcatctccataaaccggctttcgtcttcaagacagcgcatatccagccataaacggccatcataaattcggccaatgaccggtacaggcagcatgcgccagcgggccgccagcgcctccagccgactaccgcgcccgtcgtgcggggtaaaggtcatggcggcgctgggaaggcggtctaccggtaatgaaccgctgccgatttgcgacaggcagggtttaacctccagcgcaaattcatcgccgtaacgtgccgccagccgcgcctgtaaccgctgcgcttgttcgcgaatcgacgcttcgctgcgggttaacagacgcagcgtgggtaatttctccgccaacgcttccgggtgcagatacagacgtaacgttgcctccagcgccgccagcgtcattttatccgcacgcagggcgcgtttcagcggatggctttgcagttgggcaatcatcgcttttttgccgacgatgatcccggcctgcggcccgcccagcaacttatcgccggagaagcttaccaggctgacgcctgcggcaatgagctgctgcggcatcggctctttgggtaagccatattgacttaaatccaccagcgaaccgctgcccagatccgccaccaccggaatatccagctctcgcccgatttccgccagttccgcttcctctaccgttttggtaaagccctcaatgctgtaattactggtatgcaccttcatcaacagcccggtattttcatttaccgcctgacggtaatctttcgcgtgcgtccggttggtggtgcctacttcatgcagcgtacagcccgcctggcgcataacatccggaatacgaaacgcgccgccgatttcgaccagctcgccacgcgaaaccaccacctctttgccgctggcggtcgctgccagcatcagcaataccgccgccgcattgttattgacgatacaggcgtcctccgccccggtgatacggcataacagcgtcgccaatgcccggtcgcgatgcccccgcccggcgccatccaaatcgtattccagcgtcaccggcgcgcgcatcgcctgcgttaccgcctcaatcgcttcttgcgcctgcaatgcgcggccaagattggtgtgcaacaccgtccccgtcaggttaatcaccgggcgcagcgcgctttgcgccgcattttccagccggagtttcgcctcttgcgcccagtctgcgtaccagtcgggaagcgtttgcgtattccggatgacgtcgcgcgcgtcgtcaagcatccgcctaagcagatcaaccacctgggtatggccataccgatcgcgcagagaaagaaaggcgctatcgtgcaataaacgatcgatagcaggaagctggctgtagagtgtacgcgtttcgcttgtcatgaaaatgcctggctgttggtggccctctcctggcgggagagggatatcgacataagggggattgtaacgtgagtttgctcaggcggacataatgcgcgtcaagcctttggcgcttcggtgcgggcaaaactttcgcgttgaaaaagcgtttcgaccagtttgaccaggtgggggcggctaacacaccagccaggcgcgacccggcggaagttgagatagcctaccgcacaggcaatcgcgatagtcgccagattgaccgtatccgtttttagcgtcccgtcgctcagataactttcgagcatatccaggctgcggttgattttttcccgctggcgcagcagttccgtttccgattgttgcgccgtcgggcgcgcctgttcgcgtacagacaccaacgctgcatccataatgccgtcagccaacgcttcaagctggcgaactttaagcgctgccatcgggtcacgcgggagcatcgctggcgcgatatccagcagttcaatatattccgcgatgatcggcgaatcgaaccagtactcccctttctccgtcaccagcgctggcaccttacccagagggttgtattgcgccacgccgttatccgcctcgtaaggtagttcattaataaattcgaaggtaatacccttttcgagcagcagaacagagattttgcgcacaaaagggctggtgtagctaccgatgagtttcatgccgtgtcctttttgccaaccagtaaaaatcatagtatggctcaaataagacgaaaagagacacaaaaggaggttgctgaatgacataacgtgagaggactcgcgacaaaatgtttgtcggatcgtattgacgttacccgggcttaaaatttcttgtgaagaggatcacaaaaattcaacaaagcaccaaaataaaaatgtgaaatatctcacataaaatggccttttaagggctaaaaattagattcgttgtttttttacacagccactttgtgatcaatatcacatcaattacctctctaccccctatatttatgtgacgcaaatcacataaattgtccctgtctggacagttgaacgattcagtgccagattgcgcagtatctacactacagggtccggctacctctgccgctacattaacaaacctcgggctttcagcctgcgcgacagcaacataagaaggggtgtttttatgtcatccgatattaagatcaaagtgcaaagctttggtcgattcctcagcaatatggtgatgcctaatatcggcgcgtttatcgcgtggggtattatcaccgcattatttattccaacagggtggttgcctaacgaaacgctggcgaaactggttggtccgatgatcacctacctgctgccgctgctcatcggttataccggcggtcgtctggttggcggcgaacgcggcggcgtagtgggcgctatcactaccatgggcgttattgtcggcgcggatatgccgatgttcctcggctcgatgatcgccggtccattaggcggctactgcattaagaaattcgacagttgggtagacggtaagatcaaatccggttttgagatgctggtgaacaacttctccgctggcattatcggtatgatcctcgccatcctggcgttcctcggtattggtccggcggttgaagtcctgtccaaaattctggcggcgggcgttaacttcatggtggcgcacgatatgctgccgctggcgtccatttttgttgaaccggcgaaaatcctgttcctcaataacgcgattaaccacggcatcttctcaccgctgggtatccagcagtcccatgaaatgggtaaatccatcttcttcctgattgaagctaacccgggtccggggatgggcgtcctgctggcgtacatgttcttcggtcgcggcagcgctaaacagtctgcgggcggcgcggccatcatccacttcctgggcggtatccacgaaatttacttcccgtacgtgctgatgaacccacgcctgattctggccgttatccttggcggtatgaccggcgtattcaccctgaccatcctgaacggcggtctggtctctccggcgtctccgggttccattctggcggtactggcgatgacgccaaaaggcgcttacttcgctaacatcgctgccatcgtggcggcaatggcggtctccttcgtggtttctgcaattctgctgaaaaccagcaaagtgaaagaagaagatgacattgaagcggccacccgtcgtatgcatgacatgaaagcggaatctaaaggcgcctctccgctggcggctggcgacgtgaccaacgacctgagccatgtgcgtaaaatcatcgtggcttgcgatgccggtatgggttccagcgcgatgggcgcaggggtactgcgtaagaaagtacaggatgcaggcctgagccagatctccgtcaccaacagcgccattaacaatctgccgccggatgtagatctggtcattactcaccgtgacctgaccgagcgcgcgatgcgtcaggtaccgcaggcgcagcatatttcgctgaccaacttcctggatagcggcctgtacaccagcctgaccgaacgtctggttgccgcacagcgccacaatactaatgaagagaaagtacgcgaccatctgaaagacagctttgaggagggtgataacaacctgttcaagctgggcgcggagaatatcttcctgggccgtaaagccgctaacaaagaagaggcgattcgctttgccggtgaacaactggtgaaaggcggctatgttgagccggaatacgtcgaagcgatgctggaccgcgaaaagctgacgccgacttacctcggtgaatccatcgcagttccgcacggcacggtggaagctaaagatcgcgtgctgaaaaccggcgtggtgttctgccagtatccggaaggcgtacgcttcggtgaagaagaagacgatattgcccgtctggtcattggtatcgccgcacgtaacaatgagcacatccaggtcatcactagcctgaccaacgcgctggatgatgaatccgtgatcgaacgtctggcgcacaccaccagcgtggatgaagtgctggaactgctggcaggtaaaaaagcttaacagttaagcatccccaaaatagttcgagctgcaggaaggcggcaacgcagtgaatccccaggagcgtacataagtacgtgactggggtgagcgaggagagccaacgcatctgcagttcgaaatatgaaggcgatatcctctcccttgtggagagggttaggttgagggaaaagcctcaccccagccctctcgggtaaaaacattaatgaaggttaatactatgaaagcattacattttggcgcaggtaatatcggtcgtggctttatcggcaaattgctggctgacgcggggatacaactgacgtttgcggatgtaaaccaggtcgtactcgatgccctgaatgcccgtcatagctatcaggttcatgttgtgggtgaaaatgagcaggtggataccgtttccggcgtcaacgctgtcagcagcatcggcgatgatgttgtcgacctgattgcccacgttgatttaatcaccactgccgtgggcccggtggtgcttgagcgtatcgctccggctatcgctaaagggctggtaaaacgtaaggcgcagggcgtggatgccccgctgaatatcatcgcctgtgaaaatatggtgcgcggcaccacgcagctgaaaggccacgtaatgaacgcgctggcggatggcgataaagcctgggttgaacagcacgtcggttttgtcgattccgccgttgaccgtattgtgccgccatctgcttctgcgaccaacgatccgctggaagtgacggtagaaacgttcagcgagtggattgtcgataaaacccagtttaaaggcgcgttgccaaacattccggggatggagttaacggataacctgatggcatttgtcgaacgtaaactcttcacgctgaacacaggtcatgctataaccgcgtacctcggcaaattagccggtcatcaaaccattcgcgacgctattctcgatgagagtattcgcgcggtggtgaaaggcgcgatggaagaaagcggcgcggtgctgatcaaacgctacggttttgatgccgacaaacatgcggcatacattcagaaaatcctcggtcgttttgaaaacccgtatctgaaagatgacgtcgaacgcgtaggtcgtcagccgctacgcaaactcagcgcgggcgaccgtctgatcaaaccgctgcttggcaccctggaatatggtctgccgcatgtaaatctggtcaaagggatcgcggcggcgatgcatttccgtagtgatgaagatccgcaggcgcaggagttggcggctctgattaccgaaaaaggcccgcaggccgcgctggcgcaaatttccgggctggatgccaatagcgatgtggtggcggaggcggttaacgcatataacgcgaccaaatgacgcagaatccggcgcaggttagcctgcgcccaaataacagattgtcagatatgcaggcaataatggaacaaacccaggcctttgaaaatcgtgtgcttgagcgtctgaatgctggcaaaaccgtacggagcttcctgattaccgccgtcgagttattgaccgaggcggtgaatattctggtgcttcaggtgtttcgcaaagacgactatgccgtgaaatacgctgtggaaccgttgctggacggcgacgggccgctgggcgatctttcggtacgtctgaaacttatctatggcctgggcgtactcagccgcaccgaatatgaagatgcggagctgttaatggcgctgcgcgaagagctgaatcacgatggcaatgagtacgcctttaccgacgatgaaatcctcgggccgtttggcgaactgcactgcgtcatggcgctaccgccgccgccgcattttgatacgtccgacgcggcgctatacgccatgcaaattcagcgctaccagcaggcggtgcgttcgacgatggtcctctctctgaccgagctgatttctaaaatcagcttaaaaaaggcctttcaaaagtaaatcccgccgttaacctctttcttcttcttttggtcggtacagccgccggtaatattccagacgctgcaaataaatgggcgcgctctccgacggcacctcggaaggaacataatcacgcggcggcgttttattcaggtattcacggaacgcctggctggacgccataaaatcgacggctttatcaataagaagtggtacgttctcacctatttttgccatgatagatcctccatgtgggacccgcgtctgactcccgcggtcgcttatttgagtttaggatcaatttagcgttgtcattgaggaaaatgtgcttaatcgcttttcttgccgacaaaagggcgcttcatcttttctttcgacaaaaaggattttattctcaacgagataattaaataatgagcagtgtaatacttgccataattgattatctttacgtcatgagttgtgaagaatcactcactgcgcgcatactataaggtatctatcccatttctatcagaagctatcccatgaaagaagttgaaaaaaacgaaattaaacgcctgagcgatcgtcttgacgctattcgccaccagcaggcaggtctctctctggttgaatccgccgataaatacgcggagctggaaaaagaaaaagagacgctagaagcagaaattatccgtctgcgcgaagtacacagccagaaactgagtaaagaagcgcagaagctgatgaacctgccgtttcgccgcgcgatcactaaaaaagagcaggccgacatgggcaagttgaagaaaagcgtgcgtggcctgattgttgtccacccgatgacggcgctgggccgggaaatggggctcaaagagatgacaggtttcgcgaagagcgagttctaaaccttccgcatcccaggctctcaggacacccgttgtacggaggatgtcttgagagcatcgggctatattccgaatttttcatggaactatttacaccgcttatatacaagttcatttttaacggtagtccctgctttttcaggatgaaaaattccactatcatgcctgtttgtatttatacaatgaatttttttcatccccttttcttatatcccgcagaatatgattgacccgcaaaattaaataacattatcatccctgaaaaaaaatccccatacataaacattataattatatttttataaagcattgctatgagcaattgataaataacgtcgggtttttgcgcgcttctatagaagcgacgaatgttttcattctaaccatacgttaatgagttattggcaatactcgctgaatgatgagctagttgtataaataacaggttaactatttatattatataaattattaacaaggatatttcatatgcacaaaaatggaaaatttatccccctgcttgcgttgggattcacattctttttatctggttgtgattacttcgcagataaacaccttgttgaagaaatgaaagaacaacaaaaagaacaagaaacaaagataaacctgttagaaaaacaacaaaaagaacaagaagcaaagataaatctgttagaaaaacaacaagctacgattatcaacacaaccaaaaaggtcaccgaagtcgttggccgcgttgaacgcaaacaacggctattcgactatacagaactggacccatcacaaacgcactattttattattaacaacggcaatatcggattagccgggcgtattctatctattgagccaatagataatggaagtgttattcatcttgatttagttaacttactcagcattccggtatcaaaccttgcgtttaatatgacatggggtacgaaaaaaccttccgaggcaaaagatctgcctcgctggaaacaactcctgctcaacacgaaaatggactcgacaatcgaactcttaccgggagcatggacaaacgtcacgctaacattaaaaggcgtatcgcccaataatcttaagtatctaaaaataggtattgacatggagaatgtcatattcgacagcatacaacctattaacgatacaaaaaagaagccaaaaaaataatagccattgatacaattattttagaaaaggaaattactcattcatgaatagaatatttaaagtcctctggaatgccgctacgggaacatttgttgtcaccagcgaaaccgcaaaaagccgcggcaaaaaaaacggccgcagaaagctggcagtttccgcactcatcggtcttagcagcattatggtttctgcggatgcactggccaacgcaggaaacgatacaggcgacggcgttactccaacgggtacccagactggaggaaaagggtggattgcaattggtaccgatgccacagccaatacttacaccaacgttgatggcgcaagcgccgcaatgggttataaagcctccgcgatggggaaatggagtaccgccattggttcctacagccagtccaccggcgactcttcgttagcgcttggcgtaaaatcggtttcagccggtgaccgggccattgcaatgggcgcctcatcctcagccagtggaagttattcaatggcaatgggcgtgtatgccaattcgagcggcgcaaaatcggttgcgttaggttataaatctgtcgcgagcggagcaacttcctctgcattaggttatcaagctactgcgagcggcgacgacagcgctgcttttggtaatggcgcaaaagcgataggcaccaactcagttgcccttggctcgggctctgtcgcccaggaagacaattccgtcgccgtgggtaacagcaccactcagcggcagataacctacgttgctaaaggcgacatcaattccaccagtaccgatgccgttacaggtgcgcaaatttattctttaagtcaatccgtcgccgaccgactcggcggaggggcttccgttaatagtgatggtacagtgaatgcgcccctctacgaggtaggcacaggcatctacaataacgtaggtagtgcattaagcgcacttaacacgtctatcactaacacagaggcctctgtcgcaggattagccgaagacgcgctgttgtgggatgaaagcatcagcgcctttagcgctagccacacgggaaacgccagcaaaatcaccaatctggcggcgggtaccctggctgcggacagcaccgatgccgttaacggctctcagttgtttgatacaaatgagaaagtggataagaacactgctgatatcgccaccaataccggcagcatcaaccaaaacactgccgatattaccgctaataccgacagcattaaccagaacacaaccgatatcgccgccaatacgaccagcatcaatcagaacaccactgatatcgccaccaacaccaccaatatcaacagtctgagcgactccgtcaccacgctcaccgatgatgcactgctttgggatgcagcctctggcgcattcagcgctaagcacaacggaagcgacagcaaaatcaccaatctggcggcgggtaccctggccgctgacagcaccgacgccgttaacggctcccagttgtttgatacaaatgagaaagtggatcagaacaccgctgatatcaccaccaataccaacagcatcaatcagaacaccactgatattgccaccaacaccaccaatatcaacaacctgagcgattccatcaccacgctcaccgatgatgccctgttgtgggatgcagcctctggcgcattcagcgctaaccacaacggaagcgccagcaagatcacaaatctggcggcgggcaccctggccgcggacagcaccgatgcggtgaacggctcccagttgtttgccaccaacgaaaatgtgtctcagaacaccgctgatatcaccaccaataccaacagcatcaatcagaacaccactgatattgccaccaacaccaccagtatcaacaacctgagcgattccatcaccacgctcaccgatgatgccctgttatgggatgcagcctctggcacattcagcgccagccgtagcggaagcgccagcaagatcaccaatctggcggcgggcaccctggccgcggacagtacagacgcggtgaacggctcccagttgtatgaaaccaaccagaaggtggatcaaaacacctctgctatcgcagatattaatacgtccatcaccaatcttagctctgacaacctgagctggaatgaaacaacgagttcgttctctgccagccacggaagtagtacgacaaacaaaatcaccaacgttgctgccggagagctgtctgaagaaagtaccgacgcggttaacggatcgcagttgttcgaaaccaatgaaaaagtggatcagaacacgaccgatatcgccgccaataccaccaacatcactcagaacagcaccgcgattgagaacctgaatacttctgtctccgacattaatacgtccattaccggcctcactgataacgctctgttatgggacgaagacaccggcgctttcagcgcaaaccacggtggaagcaccagtaaaataaccaatgtcgccgccggggcgctttctgaggacagtacagacgcggtaaacggatcacagttgtatgaaaccaaccagaaggtggatcaaaacacctctgctatcgcggatatcaatacgtccatcaccaaccttggtaccgatgcactgagctgggatgacgaagagggtgcgttcagcgccagccacggtaccagcggtaccaataagataaccaatgtagcagcaggtgaaatcgccagtgacagtactgacgccgttaatggctctcagctctatgaaactaacatgctgatttctcagtataatgaatctattagccaactagccggcgataccagcgaaacctatatcacggaaaatggtaccggcgtgaaatacatccgtacgaatgataacgggcttgaaggccaggatgcatacgcaacgggtaacggcgcaacggcagtaggttacgacgccgtcgcctctggcgctggcagtctggctcttggccaaaacagcagcagcagcattgagggcagtatcgctttgggcagtggctccacctctaaccgcgctattacaaccggtatacgagaaacgagcgcaacaagcgatggcgtggtgattggctacaatacaacagacagagagttgctgggcgcgttgtcattggggacggatggagaaagctatcgtcaaattaccaacgttgctgacggctctgaagcgcaagatgcggtaacagttcgtcagttacaaaatgccattggtgcggtcactactacaccgaccaagtactaccacgcaaactcaacggaagaagattcactggctgtcggaactgactcactggcaatgggtgcgaagaccatcgtcaatgctgatgcaggtattggtattggtctgaatacactggtgatggctgatgccatcaacgggattgctatcggttctaacgcacgcgccaatcatgcaaacagtattgcaatgggtaatggttctcagaccactcgcggcgcacagactgactacaccgcctacaacatggacacaccgcagaactctgtcggtgagttctctgtcggcagtgaagacggccaacgtcagatcactaacgtcgcggcgggttcggcagataccgatgccgttaacgttggtcaattgaaagtaacggacgcgcaggtttccaggaatacccagagcattactaacctgaatactcaggtatcgaatctggatacccgcgtcaccaatatcgaaaacggcattggcgatatcgtcactaccggtagcaccaagtacttcaagaccaacaccgatggcgcagatgcaaatgcccagggtgcggacagcgtcgcgattggctctggctctattgctgccgctgaaaacagcgtggcgttaggcacaaattccgtcgcagatgaagctaatactgtgtctgtcggctcttctactcaacaacgccgtattaccaacgttgccgcaggggtgaacaacactgacgcggttaatgtggcgcaactgaaagcctcagaagcaggctccgtgcgttatgaaaccaatgcagatggctcggttaactacagtgtgctcaacctgggagacgggagtggcggcaccactcggatcggcaatgtttctgcggcggtgaatgatacggatgcggtgaactatgcgcaattgaaacgcagcgtcgaagaagcaaacacttataccgaccaaaaaatgggtgaaatgaacagcaaaatcaaaggcgtagaaaacaagatgagcggcggtatcgcctcagcgatggcgatggccggtctgccacaagcctacgccccgggcgccaacatgacctcgattgctggcggtacgtttaatggtgaaagtgccgtcgccattggtgtctccatggtaagtgaaagcgggggctgggtgtataaattgcaaggaaccagcaacagccagggcgattactctgcggccattggcgcgggcttccagtggtaatgaagtaacaacactcccgacatcaaaggcaatggcataatgccattgccttttcacttccctttgctgtcctctcccctcaattggccctaccaattttagccagttaccacagcctactcacatttcattaaattaactctacaataccgttgccaataaataacatctggttaactatttgttgtcattatccatacacaacaatattggcaggaccacttttacacataatgtgaccccaacgagatgagcaaagattcatcccattatgcgtgtggttctcaggagacctgcaatgaacctctggcaacaaaactatgacccggcgggtaatatctggctttccagcctgatcgcatcgctcccaatcctgttcttctttttcgccctgattaaactcaagctgaaaggctatgttgccgcttcgtggacggtggttatcgcgctcgccgtcgcgctgctgttctataaaatgccggtcgatcacgcgctggcatcggtcgtgtatggcttcttctacgggctatggccgatagcctggataatcatcgccgcggtctttgtctataaaatttcggtcaagaccgggcagtttgacattattcgctcgtcaattctgtcgattacccccgaccagcgtctgcaaatgctgattgtcggcttctgcttcggcgcgttccttgaaggcgcggcaggtttcggcgcgccggtggcgataaccgccgcgctgctggtgggtctgggctttaatccgctgtatgcggcagggctgtgcctgattgtaaacaccgcgccagtcgcctttggcgcgatggggatcccgattctggttgccggacaggtcacgggcctggacagctttgaaatcggtcagatggtcggtcgtcagctaccgttcctgaccattatcgtcctgttctggattatggcgattatggacggctggcgcggcgtgaaagaaacctggcctgcggtgatggtcgctggcggctcgtttgctatcgcccagtatctcagctccaactttatcgggccggaactgccggacatcatctcttcactggtgtctctggtgtgtctgacgctgttcctcaaacgctggcagccggtacgcatcttccgcttcggcgatatgggcgcgtcgcaggtcgatcagacgctggcccgcacccgctatacgacagggcaaattgttcgcgcctggtcgccgtttctgttcctgaccgccacggtcactctctggagcgtaccgccgtttaaagcgttgtttgcccccggcggcgcgctgtatgactgggtaattaacgttccggtaccgtatctcgataaactggtcgcccgtatgccgccggtcgtacacgaagcgaccgcttacgcggcggtgtataaatttgactggttctccgccaccggcacggcgatcctgtttgccgcgctgttgtctatcgtctggctgaaaatgaaaccctcagccgcaatccagacctttggcagcacgctgaaagagctggcgttgccgatttactccatcggcatggtgctggcgttcgcgtttatctcgaactattccgggctttcttccacgctggcgttagcgctggcgcacaccggcagcgccttcacgttcttctcgccgttcctcggctggctgggggtattcctgaccggctcggatacctcatctaacgcgctgtttgcctctctacaggctaccgcggcgcagcaaatcggcgtctctgatgtgctgatggtggcggcgaataccactggaggcgtaaccgggaagatgatctcgccgcagtctatcgccatcgcctgcgcggcggtggggctggtagggaaagagtccgatctgttccgttttaccgtcaaacacagcctgatcttcacctgtatggtgggcgtgatcactacgcttcaggcctatgttttaacctggatgattccgtgattgtgatgccaaaacgcctgtcagacgagattgcctctcgcgtgcgggcgctgattgaagaacaaaacctggaagcgggcatgaaattgcccgccgagcgccagttggctctacagcttggcgtatcacgcaactctttacgcgaagcgctggcgaagctggtcagtgaaggcgtgctggtgagtcgtcgcggcggcgggacatttgtccgctggcagcacgaaacctggtctgaacagaatatcgtgcaaccgctgaaaatgctgatggcgaacgatccggactacagtttcgacattctggaagcccgccacgccattgaagccagtacggcctggcacgccgccatgcgtgccaccgctgccgacaaagagaaaatcagactctgctttgatgcgacgctcagcgaagacccggatctcgcctcccaggccgacgtgcgctttcatctggcgatcgcggaagcctcgcacaatgtggtgctgttgcaaaccatgcgcggtttcttcgacgtcctgcaatcctccgtcaaacagagtcgccagcgtatgtatctcgttccgcccgtattctcaaagctgacggaacaacaccaggcagtgatggacgccattctggacggtaacgccgagggcgcgcgtaaagcgatgatggcgcacctcagttttgtccacaccacgattaaacgatttgatgaagaccaggcccgccaggcgcgtattacccgcctgcccggcgaccataatgagatgaccagggagaataaatcatgattatttcagcagccagcgattatcgcgccgcagctcagcgcacgttgcctcctttcctcttccactacatcgacggcggcgcgtatgcggaatataccctgcgccgaaatgtggaagacctgtcgcaagtcgctctgcgccagcgcgtgctgaaaaatatgtccgatttaagcctggaaacgaccctgtttaacgaaacgttgtcgatgccggtggcattagcgccggtaggcctgtgcggcatgtacgcccgtcgcggcgaagtacaggccgccgccgccgcagacgcaaagggcattccgttcaccctttccaccgtctccgtctgtccgattgaagaagttgcaccaaccattaagcgcccgatgtggttccagctttatgtactgcgtgaccggggctttatgcgcaacgcgctggaacgtgcaaaagcggcgggctgctccacgctggtctttaccgtggatatgccaacgccgggcgcgcgctaccgtgacgcccactccgggatgagcggcccaaacgcggccatgcgccgttactggcaggcggtgatgcaccctaaatgggcgtgggatgtcggcctgaacggtcgcccgcatgatttaggcaatatttccgcctatctgggtaaaccgaccggccttgaggactatatcggctggctggcaaataacttcgatccgtccatctcctggaaagatctggagtggatacgcgaattctgggacggcccaatggtgatcaaagggatcctcgatccagaagatgcccgcgatgcggtacgtttcggcgctgacggtatcgtggtgtcgaatcacggcggccgccagctcgatggcgtgctctcttccgcccgcgccctgcccgccattgccgatgcggtgaaaggcgatatcgccattctggcggatagcgggatccgtaacgggctggatgtcgtgcgtatgattgcgttgggggccgataccgtactgctgggtcgggcctatctctacgcgctggcgacggcaggaaaagcgggtgtcgccaacctgctggacctgattgagaaagagatgaaggtcgccatgaccctgaccggcgcgaaatccattagcgaaatcagtggcgattcactggtgcaggaactggggaaaagtttgcccgccgcgctggcgccaatgagcaaaggcgatgccgcctgaacgcctggcgcgtgagagcccggtaaatttctgctattctgcccccgcatttaagggggcatcatgcttaacatcgtactcttcgaaccagaaatcccgccgaataccggcaacatcattcgtctttgcgccaataccggctttcgtctgcacatcatcgaaccgatggggtttacctgggatgataagcgcttacgccgcgcagggctggactatcacgaattcgccgcggttcagcgccatcacgattatgccgcctttgtcgccgccgaaaatccgcagcgcctgtttgcgttgacgacaaagggcacgcccgcccatagcgccgtaagctatcaggatggcgattatttgatgtttggcccggaaacgcgcggcctgcccgccagcattctcgatgcgttgcctaaagagcagaagattcgcattccgatgatgccggatagccgtagcatgaacctgtcgaatgcggtgtcggtggtggtgtatgaagcgtggcgccagttaggatatcccggcgcggtattgcggtcgtaatatattcaatgccggatggcggctaacgcctgatccggcctggccgatcccgatggcatgttcccgtttatgcggactctcgcccaatcaaatgaaagccaatatccacaatagcttctgcgcacggtttctgttcaatacgatcggccaacagcgtagcggcgcgctggccaatggcgcgtctgtcaacgcttacggtagtaattgatggtcgattgctggcggcaaaatcaaggtcgccaaaaccaataaccgctaaatcatgcgggatgcgcaaaccacggctttccgcctccatcatcgccccctgtgccagggtatcagaactgcaaacaatgacatcaaacgtcccttcgtcaaaaagctggcttaaaccgctgcgccccagcgaaagcgatgccggaagggggacatctacctgcggtacggcatgaatagcgtggcgttgaagaacactacataacccctgcttacgttgcgcggctcggcgatcggcagtccacaacaagccgggacgacgatagcccttactcagaagatactcccccgtcgcctgcccgactttttcatgggaaaaaccgaccagcatatcaagcggcgtgggcgttaagtcccaaatttccaccaccggaatagccgcgttcaggatgacctttttcagttctatcgtgtgatggatcccggtaagcaccacgccatcggggcggcgggaaagcagtgtcgccaccaactccgcttccgtttgttcggtatatcccgccacgcacagcaatatgtgatatccgcgtcgggccagttcatcgctcagcgactggatggtatcgacaaacatgttgttgttaatttgcggcacgacgacagcgattaatttactccgtcgcgacgccagaccaccggctaacgcgttgggtatgtagcctgtgacgcgaaccgcctgcatgactttctcaaccgttttggggcgaaccagttgtggcgaattcaatgcccggctgactgtcatcggagacagcccggcgctacgtgctacatcttccagcgtcggcgcacgaggtgatttggttctcttcacgtctgatgcccctgcaaagattggctgatttatccgcgcattattcatcatgcctgcggctattgccagcttcgcatcaggaaaggccgtaaatacagtagcttatcaagctcagtcattacaaaatgatagcgccatcattttgtattatgcatttccccagatatttttggatcgtgatccattttgcaataaatcctgctttttatacgacatatgtgatcaaatgttcaaatcaacatcaactttctggatcctgcgttcgcttaataataaaaatgttagcgcaatcattttgtgattatcaggagaaaaaaaatggctttaagcgcgaattccgacgccgtaacgtatgcaaaagcggcgaataccagaaccgcggcagaaaccggcgatcgtatcgaatgggtgaagctatcactggcttttctaccgctggcgacgccagtgagtgacgcgaaggtactgaccgggcgccagaaacctttgaccgaagtggcaatcatcattgccgaaatccgcagtcgcgacggctttgagggcgttggttttagctactccaaacgtgctggcggccagggtatttatgctcacgccaaagagatagccgataatctactgggcgaagatcccaatgatatcgacaaaatatacaccaagctgctgtgggccggagcctcggtggggcgtagcgggatggcggtacaggctatctcccctatcgatatcgccttatgggatatgaaggctaaacgtgccggtctgccactggcaaaactgttgggcgcgcaccgcgactccgttcagtgttacaacacctcaggggggttcttgcatacaccgctcgatcaagtgctgaaaaatgtggtgatttcccgcgaaaatggcattggcggtattaagttgaaagtcggacaacccaactgcgctgaggatattcgccgcttaaccgcagtacgtgaagcgcttggggatgagttcccgttaatggttgacgctaaccagcagtgggatcgcgaaacggctatccgcatggggcgtaaaatggaacagttcaaccttatctggattgaagaaccattagatgcttacgacatcgaaggccatgcccagcttgctgccgcgctggatacgcctatcgccaccggggaaatgctgaccagtttccgggaacacgagcagttgattctgggcaatgccagcgatttcgttcagccagatgcgccgcgtgtcggcggtatctctccgttcctgaagattatggatctggcggcgaaacacgggcgtaagctggcgccgcactttgcgatggaagtacacctgcacctttccgcagcgtatcccctggagccgtggctggaacatttcgagtggctgaacccattattcaacgagcaacttgagctgcgcgatggccgcatgtggatttccgatcgtcatggtctgggtttcacgctcagtgaacaagcgcgccgctggacacaattaacatgtgaatttggcaaacgcccttaacccgactggcgggaatccgtcccgcctctcttaccttacaggatgcattctgcccttatctgaggagtagataatgaacacaataataaagcgcacaaaagtgcgtcataccattcttatatttttatttcttgctaccgtatttaattatgcggatcgcgcaactctatccgtagttgccccaataatgagtaaagaattaggttttgatccggaagcgatgggcctggccttctcctcatttggtattgcctatgtcattatgcaactacccggcggttggctattagaccgctacggttcacgactggtttacggttgcgcattgattggctggtcgttagtaaccatgtttcagggaacgatctatctgtatggcagcccattaattgtactggttattctacgtctgctgatgggcgcgattgaagcgcctgcctttccggcgaacagtcgtttaagcgtacaatggtttcccaataatgaaagaggcttcgttacttcagtttatcaggctgcgcaatatatctcgctgggcattatcaccccgctaatgacgatcattctgcataatttaagctggcattttgtcttctattatattggcgctattggcgtgatgctcggtatattctggttaatgaaagtcaaagatccgatgcaccatccaaaagttaatcaagcggaaattgactatattcgtagcggtggtggcgagccctctctgggctgtaaaaaggagccgcagaaaataacgttcgcgcagattaaaaccgtctgtgttaaccggatgatgatcggtgtttatatcgggcaattctgcgtcacctctatcacctggttcttcctgacctggttcccgacctatctgtaccaggcgaaaggcatgtcgattctgaaagtcggttttgtggccagtattccagccattgccggttttattggcggcctgctcggcggcgtgttctccgactggctactcaaacgcggctatagccttaccgtcgcgcggaaattgcctgttatctgcggtatgttgctctcttgcgtaattgtgatcgccaactacacctcttcagaatttgtggtcattgcggcgatgagtctggccttttttgccaaagggtttggtaacctgggctggtgcgtactcagcgacacctcgccgaaggaagttctgggtattgctggcggcgtatttaacatgtgcggcaatatggcaagcatcgttacgccactggtcatcggcgtgattcttgccaatactcagtcgttcgactttgccattttatacgttggctcgatgggacttattggtctcatttcatatctgtttatcgtcggcccgctggatcgcatcacgctgacatcatccgcagcctgattgtccacattgcgaattcttcgctccgctgttccgggattgcactccatcggaacagcgttttttagttgtaccgcgcaattcagatgccgtcgccatactcaaacgtatggtgtatcccgttgaaatgctggtccatatccatcgacggcttatcgctgcccggcttgccgacaatacgcgccggaacgcctgcggcggtagtgtgcggcgggacaggctgtaaaacgacggaacctgcgccaattttcgcgccgcgccccacctcgatattgccgagaattttcgcgcccgcgccaatcatcacgccttcgcggattttaggatgacgatcgccgctcgttttcccggtaccgcccagggtgacggattgcaagatcgacacatcatcttcaataaccgccgtctcccccaccacaataccggtggcatggtcgagcataatcccgcggccaattttcgctgccgggtgaatatccacctgaaacgagaccgaaacctgattttgcaggaagatagccagcgcgcggcgacctttattccacaaccagtgaccaatgcggtaggcctgtagcgcatgaaagcctttcagatataacagcggcgtggagtatttatccaccgccggatcgcgagtgcgcacggcctgaatatcgcaggctgccgacgcgatcatttccgggtcggcggcataggcttcttcaactacttcacggatagcgatagcgggcatgatgggcgaagccagtttatttgccagcatatagctcagcgcactgcccagattttcatgcttgagtagcgtggcgtgataaaaactggccaacataggctcacagtcagctaaagcgcgggcttcagctttaatattcttccagacgatttccagttcttcacacggcatggcttactccagacgggcagaaaacgaccaacccgttctgtgcgggttgggtcgtttatgcaaacagttccttacggctagtggcgactcagctcttccttgcgggcgcgacctaataacgttaatgctgcctcgcgcgcgttttttccgcaatacaatacttgataaatttcctcggttattggcatttcaacaccaaaacggtgcgccaattcacgaacttctttcgtattgcgatagccttcgaccacctggccaatcttatcctgcgcgcctttaacgtccatgccctggccaagcatcatgccaaaacgacggttgcgcgactggttgtcggtacaggtcagcaccagatcgcctaaacccgccatccccataaaggtggcgggatcggcaccaagcgctgcgccaagccgcgacatttcggtcagtccacgcgtgattagcgccgtgcgggcgttcgcgccgaagccgatgccgtcagacatccccgcgccaatcgcaatcacatttttcaccgcgccgccaagctgcacgccgataaaatccgcattgatatagacgcgaaaactttttccgcagtgcaacagttgctggagatcgtcggcaaaggtctcatcggttgaggccagcgagattgccgtcggcaaacccgccgccagctctttagcgaacgtcggaccggaaatcaccgccagcgggatttgatcgcctaacgcctcgcgagcgacatcctgcaacaggcgccccgtttccgcttccaggcctttggtcgcccataccagacgcgcatccggacgcatcagcggtttaatctgccgcagcacgtcgctgaaaacatggcttggcaccaccaccagaatgttacgactggccgccagcgcggttgctaagtcgctttccaggtgtaacgtatcgggaaaaggcacatcgggaaggaacgcgacgttgcagcgatcgtgctccagggtcgcgatatgttttgggtcgtggccccacaggacaacctggtggccgtttctcgccagagtgatggcaagagcggtgccgtacgagccggcaccgatgactgtcattgacgcattactttggttcatcaggcatcctgatgttcttcagtaccttcgccagcctgctgctgcaaatagttcatgaacagcgcatcaaagttgaccggcgcaaggttcagttgcgggaacgtaccgcgtgaaaccaggctggtgatgcactcgcgagcatacgggaacagaatgttcgggcagtatgcgcccaggcaatgcgccatctgagtaccttcaataccgctgatggagaaaataccggcctgctgaacttcgcacaggaacgcggtttcttcccccagggaagccgttacggtaacacgcagcacaacttcataaacgtcatccgccagttgggaagatgccgtatcaagatccagtttaacctctggctgccaatctttctggaaaacatgcggtgcgtttggcgcttcgaaagaaacatccttggtatagatacgttggatctggaaagccatttcagtgttattttgttctgacatgtgtaaaaccctttagtgttgtccttaaatacttgagtacgccttaacgcaacagcggatccagtccaccacgcgcatccagcgcatacaagtcgtcacaaccgccaatgtgctgtgcatcaataaaaatttgcggaaccgtcgttcggccactacgtttgatcatctcttcacgcttcacggcgtcgccgtcaatcgcaatttcctggaaactcacgcccttgctgtttaacagcgcctttgcacgatggcaaaacgggcaggttgctttggtgtagatttcaatattggccatgacttcgctcctgtttttttacccgatggatttcatgtcgacgcaagggcaagtcattccccttgcgtcatgaaaacgacgggtaatcacttaccgcgcaccagaggcagattctcgccgctccagcctgctacgccttctttcaacacaaagaccttttcaaagccggcttttgtcagcgcgttagcggattcctggcactgcataccagaaccgtcgaccacgataatcggcttgtctttgtgcttttccagttcgccaacattgttggctttgatttcgctcggcagcaaattggtcgcgccagcgatatggcctttacggaaatcgtcacgttgacgtaaatccacaacaacggcgtcctctttgttgataaggcgcgtggcttcgccgcgtgtaatcaccttaacttttgaagtcagacctttgaacgtggtaaataaaaccgccaccagtaacgcaatccaggcgatactcagtatgggatgacggccaacaaattgcataatttcttgcatggggggtaacaactcccgacgtagtgattaaaaaaccaggaaaggagtatacctgtgcagtggcgcaaatacagccagagcgtgcactggaatgcatttttgcggggcgctacgaaaaaaaatcacgctattacttgccttctcacgccagcgcgatccctttctttgatcttctgaggctattttatcgattcagctgtagtaaaattacgcaattattttgtctattgagtatgaggttgtcgcaatgtcggtttctaaaaaacctatggtactggtgattctggatggctacggctaccgtgaagaacagcaggataacgctatcttaaacgccaaaaccccggtgatggatgctctgtgggcaaaacgtccgcataccctgatcgacgcatccggtctggaagtgggtctgcctgaccgccagatgggcaactccgaagtgggccacgttaacctgggcgcaggccgcatcgtttatcaggacctgacgcgtctggacgttgaaattaaagaacgtactttctttgctaacccagtcctgaccaatgcggtagaccaggcgaaaaacgccggtaaagcggttcatattatgggtctgctgtccgcgggcggcgtccacagccacgaagatcacattatggcgatggtggagctggccgcagagcgcggcgcagaaaaaatctatctgcacgccttcctcgacggtcgcgacacgccgccgcgcagcgctgaagcctcgctgaaaaaattcgaagacaaattcgccgcgctgggcaaaggccgcgtggcgtctatcgtcggtcgttactacgctatggaccgcgacaaccgttgggatcgcgtggaaaaagcgtatgatctgatgaccctggcgcagggcgaattccaggcagataccgctgtggctggcctgcaggccgcttacgctcgtgatgaaaacgatgagtttgtcaaagcgaccgttatccgcgccgagggccaggctgatgcggcgatggaagacggcgacacgctgattttcatgaacttccgcgctgaccgcgcgcgcgaaattacccgcgctttcgttaatgctgatttcgacggctttgcgcgtaagaaagtggttaatctgaacttcgtgatgctgaccgaatacgccgccgacatcaaaactgccgttgcctacccaccagcgtcgctggcgaatacctttggcgaatggatggcgaaaaacgacaaaactcagctgcgtatttccgaaacggaaaaatatgcgcacgtaacctttttctttaacggcggcgtagaagaaccgtttgctggtgaagagcgcattctgatcaactccccgaaagtggccacttatgacctgcaaccggaaatgagctctgcagaattgactgaaaaattggtcgcggcgatcgaaagcggtaagtacgacaccatcatttgtaactatccaaacggcgatatggtcggtcataccggcgtgatggaagccgccatcaaagcggtggaagcgctggataactgcattgaacaggtaacaaaagcggttgagtccgttggtggacaactgttgattaccgcggaccacggcaacgcggagcagatgcgcgatccggcgaccggtcaggcgcataccgcccacaccaacctgccggtgccgctgatttatgtcggcgagaaaaacgtgaaggcggtcgaaggcggcaaactttcagacattgcgcctaccatgctgtcgctgatggggatggaaatcccgcaagagatgactggtaagccgctgttcatcgtggaataatccctccccatgaggggaaaggcgattaacaccattcaacaggccgtgaaaccaagaacgttttcagtcaggcctttgttctacgccagcgtacttagcgctggcgtattgttgtgcgccttttccgcccacgcggatgaccgtgatcaactcaaatctattcaggccgatatcgccgcgaaagaacgcgacgtacgccagcagcagcaacaacgcgccagcctcctggcacaacttaaagcccaggaagaggccatctcagccgcagcacgtaagctgcgcgaaacgcaaagcaccctggatcagttaaacgcgcaaattgatgagatgaacgcctcaattgccaaactggagcagcaaaaagccagccaggagcgtaatcttgccgcgcagttggacgccgctttccgccagggcgaacacaccggcattcagcttattcttagcggagaagaaagccagcgtgggcaacgcctgcaggcctacttcggctatctgaaccaggcgcgccaggagactatcgccgagctgaaacagactcgcgaacaggtcgccacgcaaaaagccgagctggaagagaagcaaagccaacaacaaacgttgctgtatgagcagcgcgcccagcaggcgaagctggaacaggcgcgtaatgaacgtaagaaaacgcttgccggactggagtcgtctattcagcaaggccagcaacagttaagcgaactacgcgccaacgaatcacgcctacgcaacagtatcgcgcgggcggaagcggcggccaaagcgcgagcggagcgtgaagcccgcgaagcgcaggcggtacgcgataagcagcaggaagcctcgcgtaaaggcagcacctataagccgacggaaagcgagcgctcgctaatgtcccgcaccggcggtctgggcgcgcctcgcggtcaggcatactggccggtacgcggcccgatcttgcatcgctatggcgaacggctgcagggtgagctacgttggaaggggatggtgatcggcgcgtcggaaggcaccgaggtcaaagccatcgccgacggcagggtgattctggcggactggctacaaggctatggcctggtggtggtcgtagagcatggtaaaggcgatatgagcctttacggctataaccagagcgcgctggtcagcgtaggcgcgcaggtgcgcgccggacaacctatcgcccttgtgggcagtagcggcggtcagggcagaccctcgctttatttcgaaattcgtcgccagggtcaggccgtcaatccacagccgtggttgggaagataagttttgcctcagtttcgtcgctccattctcacgctggccactttgctggcgtttgcacatcccgttttcgctggcaagctcgccatcgtgattgatgattttggctatcgcccgcacacggaaaaccaggttctggcgctgccgccaaacatctccgtcgctgtactgcccaacgcgccgcacgcgcgcgaaatggcaactaaagcgcacaatagcgggcatgaggtgttaatccatctgccgatggcgccgctaagcaaacagccgctggagaaggatacgctgcgaccagatatgagcagcgatgagatcgagcgcattatccgcgaggcggtaaacaacgtgccgtatgccgtcgggcttaataaccacatgggcagcgcaatgacttccagcctgttcggtatgcaaaaagttatgcaggcgctggaacattacaatctctattttctcgacagcatgacgattggcaatagccaggcgatgcgcgcggcatccggtacgggtgtgaaagtgatcaagcgcaaagtgttcctcgacgatacgcaaaacgaggcggatatccgtcgtcagtttaatcgcgctatcgaactggcccgtcgcaacggttccgctatcgcgattggtcatccacatcccgcaacggttcgcgtgctgcaacagatggtttatcgcctgccggcggatatcaccctggtacgtccaggcagcctgctcaacgaaccgcaggtagatacgtcccgacctggtgtgacgccgcagaaaattgacgcgccgcgcaatcccttccgcggcgtaaagatgtgcaagccgaaaaaaccgctgcaaccggtctacgctacgcgctttttcagcgtcatcggcgagagcattacgcaaagttccgtggttacctggtttcagcaccagtggcaaggctgggggaaaatcgccgcgcctaaaaacgtgagcgctaagacagattgagcgccttacgggccatacgacggtgcgacaaggttttgtcgcgccattgccacagccggaaggaccagagcagcgtctgataagctgctttcgcgctgcggacgttagccatcatccgtctatacatgccagaagtaaaaatttcggcaatcatacgctggcgggtcaaaatatcaggctctttacgtaccgcatgacaaacgcgtaacgcttcccaggtaatttgctggcgaaattccgggtaaatcggaatacgacgggcataatcacgattgagcttttctaataatcgcgtaattttaatataatgccgctgataattaagatttttattgccttgtctttgcaaacggcttaccgaattatcatgcaggaaatatttatataatgattgttcggtataacgtacgcgcgtggcattaaacataacttccgtcgaccataatatgtcctgatgatgtagtccgggaacgaaagtaatattgttatcggtaattaacgcacgtcgataaacgcccatccagacaacatgcgtccagcgccgcgaggccaacgccatacgcaaccaatccggtccgcttaataccccggtggaacgcagacgatcggtcggaatagattgccaggcgtgcccggtttttcggacgcaccagtccgcattacactgcgcaacgtccagatcatcgttaagcgccatagtcatcagcgtttcatacatcttcgggtagacctggtcatccgcatcgacaaaggcgacataatcgccggtcgccgcttgcaggccaagattacgggcgacagatgcgccagcattggcctgatgaagcagtcgaacatgtgggtaatgttccgcgtaatgttttgctatctcaacggaatgatccgtcgatccatcattcacaataataatttccagcgccgaccacgtttgcgcgattaacgacgccatgcaagcattaaaatccgctcccgcattatataacgggacaatgatactcactttggttttactatttttcataacgattaccagaaaaaccttaatttaccctgcctttatactgtggctctattaagaaactattaagccgccataattaatttttacagtaaaaagcaagcacaaaactcagagtagagcgtgacgttagcgagtaaaataagagtaaagcgcaattacgaatgcttgatgtctatgacaattctttacggctttccagattttccctaacaaaaaaggttggcgaatgacaccaaccttttacgatgaaacgtatatcagacccgataaaattatcgggtctctatacccttcatacttcaagttgcttatgtgttggctacggattactcggcccatccatgggcctcgccctgacgggccgtcgcaagcgacgttcaaatctgctcccggcagatttgtcgttcaccccagtcatatagttatctatgctcctggggactcactcccttgccgcctttaagcaactcgaattattttgggtatatacatattaatcccagctcagaataacttttcctgactggcctgaacgcatggcatcaaaacctttctggaaatcatcaatagagaaacgatgggtgataatcggtgacagatccagaccggactggatcagcgccgccattttgtaccacgtttcgaacatctcacgaccataaatacctttaatgaacaagcccttaaagataacttttgtccagtcgatagacatatctgatggcggaatccccagcatcgcaatacgaccgccgtgattcatggtgtccagcatggtacgaaacgccggcggcgcgccggacatctccagacccacatcgaacccttcggtcattcccagctccgccataacgtcgttcaggctctctttcgcgacgttgaccgcgcgggtgacgcccattttacgcgccagctccagacggtattcattgacgtcagtaatcaccacatgacgcgcgccgacatgtttcgccaccgcggcggccattacgccgattggccccgcccccgataccagtacatcttcgccgaccagatcgaaagacagcgccgtatgcaccgcattaccaaacgggtcgaaaatagaggctaaatcatcagaaatgttatccgggattttaaacgcattgaacgccgggatgaccaggtattccgcaaagcagccgggacggttgacgcccacgccggtggtgttgcgacacaggtgagtgcgaccgccgcggcagttgcggcaatgaccgcaggtgatgtgaccttcgccggagacgcgatcgccgattttaaagcctttcacttcctgaccgatgccgaccacttcgccgacatattcatgccccacgaccatcggaaccgggatggttttttgcgaccagtcatcccagttatagatgtgaacgtcagtaccgcagatggctgttttacggattttaatcagcaaatcgttatggccgacttccggttccggaacgtcggtcatccagatgccctcttccgctttcagtttggataacgctttcatcttacatcctcaggcaatcacgcccagttgtttaccaatacgcgtgaacgcgtctaccgcacgcgtaatttgctcaggcgtatgcgccgcagacatctgggtacgaatacgcgcctgaccttttggtacgaccggatagaagaaaccggtaacgtaaatgccctctttttgcagttcgcgggcaaatttctgcgcgacaaccgcatctcccagcattaccgggatgatggcgtgatccgcgcctgccagcgtaaatcccgcggcagacatctgctcacggaactgccgggcgttcgcccacaagcgatcgcgcagttctgcgcccgcttccaccatctccaacactttaatagaagccgccacgattgccggcgccagggagttggagaacagatatgggcgggaacgctgacgcaaccactcaacgacctctttacgcgccgcggtataaccgccggatgcgccgcctaacgctttgcccagcgtaccggtaataatatctacgcggcccattacgtcgcagtattcatgggaaccgcgaccgttttcgccgacaaagcctaccgcgtgagaatcatcaaccatcaccagcgcatcgtatttatcggccagatcacagacgcctttcagattggcgatgacgccatccattgagaacaccccatcggtggcgatcaggacatgacgcgcgccggcctcacgcgcctctttcagccgcgcttccagctctgccatatcgttgttggcatagcgatagcgcttcgctttacacaaacgcacgccgtcaatgatagacgcgtggttcagcgcgtcggaaataatagcgtcttccgcgcccagcaacgtctcaaacaagccgccgttagcgtcgaaacaggaggaatacagaatcgcatcttccatgccgaggaagcttgccagcttttgttccagcgctttgtggctgtcctgggtgccgcagataaaacgcacggacgccataccgaaaccgtggctgtccatgcccgcttttgcggcattaatcagctcagggtgattagccagcccgagatagttattggcgcaaaagttaataacgtggcttccatccgccacggtgatatccgcctgctgcgcagacgtaataatgcgctcttctttaaacaatccttccgcccgggcggtttccagatcgttggttaactgtttgtaaaaatccccacgcattgcgattctccagactgggcaaatttcagcacatattacccaaagcgatacgttgatacgagatgacgcgtcatcacttctttaaaatgcagcataaatcacgcgtatcctcacgggttatcagtgaatggatgaatagtgttatgataagagcattcatgtctgagacagtctctgacaccataattcaaaggttacagttatgatcatcgttaccggcggcgcgggctttatcggcagcaatatcgttaaggccctgaatgataaaggtatcaccgatattctggtggtggataacctgaaagacggcaccaagtttgtaaacctggtggatctgaacattgctgactatatggataaggaagatttcctgatccagattatgtccggagaagagctcggcgatatcgaagctattttccatgaaggcgcctgctcttccaccaccgagtgggacggcaagtatatgatggataataactatcaatactccaaagagctgctgcactattgtcttgagcgcgaaatcccgttcctctacgcctcttctgccgccacctatggcggtcgcacgtctgatttcatcgaatcgcgcgaatacgaaaaaccgcttaacgtttatggctattctaaattcctgtttgatgaatatgtgcgccagatcctgccagaagcgaactcgcagattgtcggtttccgctatttcaacgtctatggaccacgtgaaggccataaaggcagcatggcaagcgtggcatttcatctgaatacacagttaaacaacggcgaaagcccgaaactgtttgaaggcagcgaaaacttcaagcgcgacttcgtttacgtgggcgatgtggccgccgttaacctgtggttcctggaaagcggcaagtccggcatctttaacctgggcacaggccgtgcggaatctttccaggccgtcgccgacgcgacgctggcataccataaaaaaggtagcattgaatacattccgttcccggataagctgaaaggtcgctatcaggcgtttacgcaggcggatttaaccaatctgcgcaacgcgggctacgacaaaccctttaagaccgtcgccgaaggcgtcacggagtatatggcctggctgaaccgcgacgcgtaagtatgaaaattttggtcattggcccgtcctgggtgggcgacatgatgatgtcgcaaagtctctatcgcacgcttaaagcacgctatccccaggcgataatcgacgtgatggcgccagcctggtgtcgtccgttattatcgcgtatgccggaagttaacgaggcgatacccatgccgttgggccacggcgcgctggaaatcggcgagcgccgcagattgggccatagcctgcgagagaagcgctacgatcgcgcctgggtgttgccaaattcgtttaaatcggcgctgattcctttctttgccaatatcccgcaccgtaccggctggcgcggcgaaatgcgctatggcctgctgaacgatgcgcgcgtccttgataaagacgcctggccactgatggtggagcgctacgtggcgctggcttatgacaagggcgtgatgcgcgcggcgaaagatctgccccagccgctactctggccacagctccaagttagcgagggtgaaaagtcgctgatgtgcagcgacttttcactatcttctgaacgtcctctgatcggcttttgccccggcgcagaatttggcccggcaaaacgttggccgcactatcactacgccgaactggcaaagcagctcattaacgaagggtatcaggtcgtgctgtttggctcggcaaaagaccatgaagccggaaatgagatcctggcggcgctgaatagcgagcagcaggcatggtgtcgcaacctggcgggggaaacccagctggaacaggccgtcattctgatagccgcctgtaaagccatcgtcactaacgattccgggctgatgcacgtcgcggcggcgctcgaccgccctctggtcgccttgtatggcccaagtagcccggatttcacgccgccgctgtctcataaggcccgggtgattcgtctcattacgggttatcacaaagtgcgtaaaggtgatacggcgcaaggctatcaccagagcctgatcgatatcacgccgcagcgggttctggaagagcttcattcgctgttgtcggaagagggcgtttaatgcgggttttgatcgttaaaacatcatcgatgggcgacgtattacataccctgcctgcgcttaccgacgcgcaacaggcgattccggggattcaatttgattgggctgtcgaagaagggtttgcacaaattccgtcctggcacagtgctgtcgatcgcgtgattcccgtcgctattcgccgttggcgcaaggcctggttttccgcgcccatcaaagcggaacgcacagcctttcgtcgggcggtatgcgcaaaccaatacgacgctgtgattgatgcgcaggggctggtaaaaagcgcggcgctggtgacgcgtctggcgcatgggataaagcacggtatggactggagtaccgcccgcgaaccgctggccagcctgttctataaccgtaaacaccatatcgcaaagcaacaacatgcggttgaacggacgcgcgagctgttcgccaaaagcctgggatacgataaaccgcagtcgcagggcgattatgccatcgcaaaacattttctgcattgccagcaggcggttagcgatccgtatgcggtgtttttacatgccacgacccgcgatgataaacactggccggaagcaaactggcgcgagcttatcggcctggtgggcaacaccggattacggataaagcttccctggggcgcgcctcatgaggaggcccgggctaaacgactggccgaaggctttgactatgtggatgtgttaccgcgcatgagcctggaggaggtcgccagagtgctggctggcgcaaaatttgtcgtatcggttgataccggcctgagccatctcaccgccgcgctcgacagaccgaatattacgctatatggcccaacggaccctgggttaattggaggttatgggaagaaccaaatggcatgctgctcaccagaacagaacctggcgaatttagatgccacaagcgtatttggaaagattcattaaagagactctgtctcatcccaaacctattgtggagaaaagatgctaaccacatcattaacgttaaataaagagaaatggaagccgatctggaataaagcgctggtttttctttttgttgccacgtattttctggatggtattacgcgttataaacatttgataatcatacttatggttatcaccgcgatttatcaggtctcacgctcaccgaaaagtttcccccctcttttcaaaaatagcgtattttatagcgtagcagtattatcattaatccttgtttattccatactcatatcgccagatatgaaagaaagtttcaaggaatttgaaaatacggtactggagggcttcttattatatactttattaattcccgtactattaaaagatgaaacaaaagaaacggttgcgaaaatagtacttttctcctttttaacaagtttaggacttcgctgccttgcagagagtattctgtatatcgaggactataataaagggattatgccattcataagctatgcgcatcgacatatgtccgattccatggttttcttatttccagcattattgaatatttggctgtttagaaaaaatgcaattaagttggtttttttggtgcttagcgccatctaccttttctttatcctgggaaccctatcgcgaggggcatggttggcggtgcttatagtaggtgttctgtgggcaatactgaaccgccaatggaagttaataggagttggtgccattttattagccattatcggcgctttggttatcactcaacataataacaaaccagacccagaacatttactgtataaattacagcagacagatagctcatatcgttatactaacggaacccagggcaccgcgtggatactgattcaggaaaacccgatcaagggctacggctatggtaatgatgtgtatgatggtgtttataataaacgcgttgtcgattatccaacgtggacctttaaagaatctatcggtccgcataataccattctgtacatctggtttagtgcaggcatattgggtctggcgagcctggtctatttatatggcgctatcatcagggaaacagccagctctaccctcaggaaagtagagataagcccctacaatgctcatctcttgctatttttatctttcgtcggtttttatatcgttcgtggcaattttgaacaggtcgatattgctcaaattggtatcattaccggttttctgctggcgctaagaaatagataaaaaaacgcgctgatacttattacggtatcagcgcgttttccatcatcaggactcaatcacttatcaaaccagtttttcatttgttcctcgaaacgctgcgctacattttcccaactgtattttgaaaacaccagggattttgctttttcggcaatctggtggcgttccttatcagcaagcgcacggttaatatcattaattatactgtcgctcgacataggttctgcgaggtgatagcccgttatgccatctaacacaaattcgctaatccccccttttttgctggcaagaaccgcttttcctgctgccatcgcttctacagccaccatgcaaaatgcttcttcaacctgagatggcacaataaccagatcggctatatgatagaagttatgcatctggtcaggagattgccccccagccataatacaatccgttccaatctcttttgcggcgtccagtactttcttttgatactctgctttttcacccttgcggcttgcataagggtcgccaacaacgacaagtttaatattacttcttaaggtacgtaattgtttgaacgcctgcaaaagcaacaggatgcctttatcaggcgaaattctcccggcatacaagagaacggtggcatcttccgcaatatttaattgctgacgaagattatcttgtgggtttcttttataagtctcagcacaaaaaccattaggcacaatactaacagcagcggcgggcaatctttcttcataaaacgctttaagaaactgactgggcacgataatttttgcatcattatcaggaagttctggttcaaatgcattatgcatgtgcataaccagttttgcattcggattgcgctctctgatctgccgatacagtttcatactattatgaataacaatgacgctatcttcctgggtagtcactttatctctaatattaaggatgcgctgggaatagggtagtgggtcgagacgagtccatttctgaaaaagacgcttataaactttactaaacccgatgtaatgaatatcacagttatcgtttattttattatattcaggatagccagcattctttatacaagcaatagcattcggtattgatagtcgttttgcaacctggtaaatccaggtttctaccgcagccgcaccacgaggaggaattgaaaatataggagtaacagtaaatatgatttttttaatcataatagctataatccagaatagttaactttatagaaaaagaaatgttataaaaaaaagaaatgcgtgccgaagcaacgaaaaataatgatttatctagtgtctagacaattttatcgtaatatatttcatcctcaagctccgaggctgtaatatatggaataatatcgtaatgaattgcagtatcatctgataaattaaagatatttaaatcactcacattttttctcataaaagtaaaaaatggcagtattttaaacagatctttactaagctcagatggcatagggctggtagattcgtcatagaaacgtgggcaactccctgttaagtcaagcccagaacatataatacggccatacttgagggaataggcaacctgaatagcggtataagcaatagtatggcaagagcaatacccgatgctgatatccttgcaaaatccagccagtcgccctcttttcgaaagaggaactgaaataagtaatgctttatgaacccgcttgaggatattaaatttaattttctttaaaaagccccctttttctcggcgataaaaggagcgaataattaaacagttttcttcaatatatttttgatcatccactgaagcctgttcgtacacatcaagattgacgatagtaaactgactgttacggctaaagttataaaaatcttcgcgccgacgatggaggaagcgaatatccgtcagaaggtacaaaaatggcttgacgttattgtttagcaaatattgaacagaaccattgactgcaatgacatctttcattcgtaacaaggacagcggcgtctttctggacgtaggaccagaaagaaaaataatacaatcttcagccgttcttttcgcaataagttgcagaacatcggcgtgagttatgaagttaacgctgcccataaaaaactcgtatgtttatcatgcaacctataaataaatgttatattcaataactaatattacatctcaaattctctcaagtatgtcataacgctgcagcaaataaaagtcagtcagccccttaaattaaaccaaacgtgctacattgatcagcgtttttccttacccttaatacgacgcaagaaatttcggagttttttcttataaatcaataagtaaaatccgatatctctcacattatttttgataccataatgtctttctaaatcaatacgatcctttgcttttcgttgtctggaaggtctttttccggacaaatcgataattctgatctcattgccttgcaggataaagttacctttatggggatcgcccgaaaccataccatgctgatgcagagaatatatcgactgtttgattttccctctcacctcgtcagaaatttctggcatatcaacaagttcaataccttcaatatactcaattatcatcacgtatgtttttacatagcgtaatgttttaatttccgccagcaggtaaaaatcattaagcgccgcaaacccttcacgccgcacacgatctgtctgatgaaaaagcttttcgtagtaatctccttttactaacgatttgaaaaagcgttcagtattttttacttttggactaaatactttgagaatatattttccgtagtctgtattaatcaatacaacttttgtatcttctatattacggaagactttaataacctgatgattataagatagaaaatctttgaatatctcaatgtatttttcaccgtcttttttgacaaagacggtatagtttttaatctttttttcaataatcataatggagatttagggaggggaattatttgtggaaaagtttacgataaagatatgcgcttccagccagaaggcctttaaaataatgaccttgcacgagaagatgtttatatcgcttcttaaattcgactatggtacgcgcatcttttgcgggaaaatctttccagggcgagttcagtcgtgcatttttataatagataactgaaggataatttgcccaggcatgccatggttttgtagcgcccgtataatgaattaaaatagtattatcattaattatattgctatattttttatgtgacttatctttcaactcacttttaatagtataaatagtattatacggtcgcggtagaaaaatgactttatcctgtaggagaatattcaaaacatcctgatcgggatatttaaaagagtcagcctctttacctgccaaaagtaaaaatgcctttttggttaaggcattctctttccataatttcaggttaacaaaaaccacgccggagttaaaataaccaccttgtaaattaaaagcgcttaatctctcatttaccttattctggatggaatcaacatcttttacgaccgcagcgatcttctctgtcagatcaagctgtaaaagatcttgcaaagatcctttgcatacaacatcggcatccaaataaagtaaggtatttaccttcttgctgagataatcgaaagcaaataaacgaaaatacattgctctcgaccatactttagtttgaggcaatacctcaaggctttctactttaataagataaagagaaatttttatgtgatgctgtacggctaaacgctctatatattttacaaaacacggggagtatgagtcacaaataatgtgaaaagcgagcgggatattattgtttaatacaactgaagcgattgatacccccacaccatcaagatagttttcatcaacgccataagaaatgtttaatacgttatcatcattattattactttcatcaaaaactttatattcagctatttctatctcaggaaatgaatccattacatcacctatgggttttattcaagaagtttacgtttaaagtaggctatataataatttatacccgaagtataatgcttctgattaaacatatgctttgccgcataacgtaactgatggctagtcactggatttaaaagtgcacaatgagaccatggtgagttgctcttagcctgtaaaaaatattgtgacacggggtaagccccccaactatgccagggcttcgttggtccgatataatgaacaaatacagtctcagcatcaactggattaataactgaatcttttaattcatagttaagactaaattgtgtattaaattttttatcaacaaaacgcgctttattcactaaaaatatatttaatacatcctgatcaaggtgcgttatgcgctgtactacctctggatcttttagcatttcaatcgctttcttagagatattttctgcagtccaaagaggtatgttaattaaaataaaaccggcattaaaatagccagaaaccagcccaggcgttgccaggctaaccgagcgcttagtccaccattccaactcgccttcagcaacgacagccgcaatctcattttcagcaaaattaagatcaataagttcctgaatactccccttacatgcaatatctgcatccagataaagtactctatctgttttatctgaaaaataatcggcgataatgaatctaaagtatgttgcataggtccagtttttggtactgggtagcgattttaagcgctcacagtcgattaggtaaacaacaatctgcgtagcgtactgttttgctaatgcctcaaatcgctgctggtcttcagagtcaaagaaatcggtaaaaacatggaaagctaacgccttctctggattagcgaggagaaccgatgcaatagagacaccacagccaaaaagaaagtttttatcaatcccataagctatattaaatttatcagcatcactatgttgtgcatagttataatctaaagtctgttgaatgacttcttcttcaaaatattttctgctcatagtgatcacttttgtaatttcgagaatattgcattattaaaatttttaaaatatagcacatcgtaaaatctctcaatcgtgccgggaataatatcatgctgatattttacttcaccagaaataacgcgattaaggtgtcctacaaaatcatctatagcacccggagtgtaaagctcaccattcaaaccgggtttaatcatatcgcgcggaccagacatacaatcagaactaatacacggaattccatatgacattgcttccagcagggtcataggaaatccctcaaatgcagaggtaagtagtaacgcggtgacattttttattttttgctgtacgacttgccacggcgcgctttgccaaccataccagatcacacgctgctcaataccaagctcccgactataggcctggcacttttcaaaatctgagccatcaccaataatatgtagctgccattcccctgtcgtacgagctaagccatcaaataaatctttaactcttttctgcccttcaaatttaagacgccctacatagagaaatacagcgggtttatcgcgctcaggcggcggcacaatgactgttttaatagagacaggattataaacgacgctaatatcttgcgctgagataccccgtgccatgatctgttctttaataccactactgatggccagatgataatccgcgtacgttatacattctgcatgttttttatggtcgagcgaaaaatgcggccacgagaaaatagtaaaatgtttaccacttttctttcgtgctttattggcataaagacatgagatgacatcaatacatatcacaatatccggtgacgtttctttcagccactgactaaaattataaacatgcttagctcgacgaagaaaacttaattttatatttgagaatgattgcgcatatttaatctcttttagccatgctttatccattttgtcattacgacaaaagaaaaacatttcacagttgatcttcggagagctattttcaaacgtatggataacgttgctaataacggtttccatccctccaaaaccggataccgcttcgccaataaaagctattttcatatataccccagagttaaaaccttaatctaaagactttagatattaaatagcaaaaatagtaatataaccctatagagtaatttttacctgacatctctctttttgctttaaggcgtagtcaatatctttattattttcgataatggaatatattgccacacctgctggcattataaaaccatgatcaaagcaaagagcaatgtccagtcttcttccaaaaaaatcatcatgttgaattatgtttttttggtttgaaatataacttttaatgttagacattctgtctatccttgtctcactcataaattactcactgagtgcataattattataattacagattttttcttattgtcctttctttaattcgagcggctttaacatctgcctgatgaatcaaccccgattctttttgcaaaatctctcgcagggggagagagaaatactcacgcataaaccggaatatatctcgctgagtcaggccaatattcattgaagaaaaataaagcccaattaaatctttgtcacgccagcgaaggggaacgtgctggcgtatctgcgcgcgatgcaggtcaattacggagatttttaaatcctcttcgcgaccagtgaaaggtaaatgcagaagaaagtggcaaatataacagtcgcgatggttaattcccccggcgtgcattttacgtaccatagtcgcaacacgcttaatgatcatccacttcacctgcgcgtccggtggattaacagcccagtcagcacagtagtcttcaaggctaatggtgggcgttaaatcttcggtgataataaatgatgttctggttagcgggtttacgcctttttcaccaaaaccaacgccgtgcatcgtatcaacgcccagctcatgtagacgatgaatggcgtgccattctctgtcagcgcccagaacaggcatacgtaacgaaatcaggttcttcacaatttctttcagcgaagtacctttatgccacttcaggaagtagcttttaccgtccagctcaaaccgcaatgttcgacgcgtctccagctctctgaacacttcgccctgtaacgtttttacttcctcaaaagcatctttaccgcgccatagtgtggttaacggcgctttcagctcaaccatctaaatcacctgtaataatatccgcggccttctccggtaagctgtataaatcctgggtatcagcataataccgcgcattttcagcccaggcgttgcgtaaggaaggctgtgtcagcgctttgagtaaaacctcatttagcgcatcctggcggaatggttcagtcatcgcttcgccacagtttgcatccacaatataatgtgcataaccgcacaccgcggttgtcagcaccggcaaaccagcagtaatggcttccagcaaaacaataccagcagcttcctgataggctggatgcagtaaaaggtcggctgccgccattaactccgcgatatcattacgtccggagaaaaaatgcacattcgtgccgacgccgcttctttcagccagtgctgcaaacttcttcggcttatcctgcccgacaacatagagcaccgtattttgccgtaaagattcgggtagcgatgccagcgcttcaatagagcgatccacacctttacgggtaaagtcagaccctacttgcaacagtaatttttgctgttctgagataccatttttctgacgataaatttgacgactgtttgggatctgttggctatattttctgtccgggtaaatccccggaggaagaatatggaaacgctccgcttcagtctgataatgtttttggaagtcagcaatctgcttattcgtcagcattaatagttgcgtcggcttgccgtgttcaaacgtggcgcgttcaaaagcagcataatgccgatagcgtgatgtcaggcgatagaaaaatcctttttcctgtgcgactttttcggcgtaacacacgtctgcggcgtaatacacatcaaggcccggcatcttattgaatccaaccacccgatcgacagggtggtcgcgcaaatggtgttgcacccaggcataatattctgcgttacgaccgtggttcgtccgggatttaaccggcacgcggattaattcaaagttatccgggcattccccttcccatgactgagtataaacacgaacctgatgccctcgcgccgccacggtttgggcaatgcgcataaaatcacgctgcagaccgccaaaaggaaaatatttatataagcaaaaggcaactctcatagcaggctgtccaaatctatggtgcgtgcctcatgcggcagcattttttccgtcgcggcgataacatcttcagccggaataacggaaaggtattttttattacgatcaagctcatgccgttcaggcatcggctgataatttcctgcccaaaactgaatgatgtcgtcggtccagggacgccagaatacatgatccgtcgcgccaaaaagacaaatgaccggcgttttgactgctgcggcaatatgaccgggggccgaatcaacgccgataaagagatccgcatggtcaatcaacgcacccaattcaggaaagcgagttttacccgccagaccagtaaccggttttgtctcacagccgcgtgcaatagcatccacgcaggccatctcgtctgcggccgggcctgacgtcagtacaacttgataaccgcggcgctgcacggcatcaataacctgcgagaatttatcattatcccagcacttaaatagctgccgtgccgtaggctgaataacaacatattgtcgggtcacaccaagttgtttgagctgttgtcgcatgttttcccaatgttccgggcgatagctcatggtggtttccgtgacatactgttttagcgctaacggctttagcgcggataatgtgcgctcaacagcatgttctcccgcataaggtactaaatgcgtaaagctctttttccatagagcagactgacgattaccgaaatcctgcgagatttttatttttgcgtttaaaaaacgcacaataagcgccacgctccactgatcggtgagattgacgaccagatcatacgagttagcacgcaattttttgattagcgatagcgcgtttttgatcttctcttttgttcctgcgcctttgttactgatgccgtagagtgcattaatctccggattttccgacaatatcggtatggtgttctggtaaagaagcacatcgatttttgcatcgggataattctgcttcagcgtgctgatgacaggggtggtaagtaacatgtctccatgaaaacgcatttttataatcagaattcttcgaaatggcttttccacaagcgactctttggttgaaattgtccggataaataagcagaaaaaagcacgctaccgccccaggcttcacagcaacccgatggctaataccgcactcattttagatgcgctagtgtaacacttctttcgcagcaatccgatacgaataatttttatacacaatcatttttttaatcataaattcaaagagataataatttatccccctcttgtgaatggtcattcccattgtctggggcgacaagggcggcaaatttcaatggattgcgtaaaaatgcaaaaataatggggttcagcgcctggaatcctcgcttctgagccaatttggcgcaaaaatgggaaaagtaatggtaaagcccaggctaaatacatagaatccccagcacatccataagtcagctatttactatgctcgaattgctttacaccgctcttctctaccttattcagcctctgatctggatacggctttgggtgcgtggacgtaaagcgccggcctatcgtaagcgctggggtgaacgctacggattctaccgccgtccgttgaaaccgggcggaatcatgctgcattccgtctcggtgggcgaaactctggcggccatcccattggtccgcgctctacgtcatcgctatcccgatctgcctattaccgtaacgaccatgacgccgaccggctcggagcgcgtccagtccgcctttggcaacgatgttcagcacgtttacttgccttatgatttgcccgatgcgctcaatcgtttcctcaataagattgatcctaagctggtattgatcatggagactgagctctggccaaatctgattgctgcgctgcacaaacgtcatattcccctggttatcgctaatgcgcggctttccgcccgctccgccgcgggttatgcgaagcttggcaagtttgtccgtacgctcttgcgccgtatcaccctgattgccgcgcaaaacgaagaagatggcgaacgctttgtggcattgggcgcgaagaacaatcaggtcacggtcaccggcagtctgaaatttgatatttcagttacgccgcagctggcggctaaagccgttacgctacgccgccagtgggcgccgcaccgtccggtctggattgccaccagcacccacgatggcgaagagagtatcgttatcgccgctcaccaggcgttattacatcaattcccgaatttattactgattctggtgccccgccatccggagcgtttcccggatgctatcaatcttgtgcgtcaggcagggttaagctacatcactcgttcttcgggcgaagtaccgtccgccagcacccaggtcgtggtaggcgataccatgggcgaattaatgttgctctatggcattgccgatctcgcctttgttggtggttcgctggttgaacgcggcggtcataacccgctggaggccgccgctcatgcgattccggtactgatgggtccgcatacctttaactttaaagatatttgcgcccgtctggatcaggcgagcggacttatcacgattaccgatgcggctacgctggcaaaagaagtttcctctttactgaccgacgctgattatcgtaatttctacggacgtcacgcagttgaagtgctgtatcaaaatcagggcgcgctccagcgtctgctgcaactgctggaaccttatctgccaccgaaaacgcattgaggactgtcatgcaaaaacgggcgatttatccaggtacgtttgatccgattactaacggtcatctcgatattgtgacgcgcgcaacgcagatgttcgaccatgtcattctggctatcgccgccagccccagcaagaaacccatgttcaccctggacgaacgtgtggcgctggcgcaaaaagcgaccgcacacctgggtaacgtagaggtggtaggctttagcgacctgatggccaatttcgcccgcgacagacaggcgaatatcctgattcgtggtctgcgcgcggtggcggattttgaatatgaaatgcagttggcgcatatgaatcgccatctgatgccgcaactggaaagcgttttcctgatgccgtccaaagagtggtcgtttatttcatcgtcgctggtcaaagaagtggcgcgccatcagggcgatgtgacccactttctgccggacaatgtgcatcaggcgctaatggataagttgaaataagtttcctaccttgccgggcctggcattttacttctgacagtgacggcaatagaacgtcgcgcgctgtgcgtgtttcgttgcgactatcggcgtaccgcatacccgacacggctcgcctttgcgcccgtacacctgcaactcctgggcaaaatagcccggcttcccatcgctttgcagaaaatccttcagcgttgtcccgccttgttcaatagagcgcagcaaaacggctttaatcacccgcgccagcaggtcgcactcctctgtcgagagtgacgacgccaggcggtcagggtgaataccagcggcaaacagcgactcgctggcgtagatattccccacgccgaccaccagcttgttatccatcagccagggtttaatcgccgtcttcttcttcgcgcatttctgctgcaaatattcgccattaaactcatcgcttagcggctccggtcccagatgcgccagtacgttatgcccttccagctctttggtccataaccaggcgccaaagcggcgaggatcggtataacgtagaattttgccgttgctcatcaccaaatcgacatggtcgtgcttttccgccggcagcgcttccggcagtatccgcaagcttcccgacatccccaggtgaataattatccagccgtcaggcagctccagcagtagatatttagcacgacgctgaacgctaaggacgggtgtatcgctcagacgataaatttcatctgaaaccggccagcgcagacggccgttacggatatgggcgtgcaggatagtagcgccaactaaatggggttcaataccccggcggctggtttcaacttcgggtaattcaggcataacgtctccggctgtgtggcaggtctcattaatatggggacggccagaaaacaaaaaaccccgccgaagcgaggtttttgttacatcaaagcgagaattatttgattttcgcttctttgtagatcacgtgctgacggacaactggatcgaattttttcagttccagtttttccggtttagtacgtttgttcttcgtagtggtatagaagtgaccagtaccagcagaagaaaccagcttgattttctcacgaatacctttagccatgatttatttcctcttagtacttagtacttttcgccacgggcacgcagttcagacagaactgtttcgatgccttttttatcgatgatacgcatacctttagcagatacacgcagggtgacaaaacgcttctcgctctcaacccagaaacggtgagagtgcaggttaggcaggaaacggcgtttagtcgcgttcagtgcgtgggaacggttgttaccggtcaccggacgcttgccagtaacttggcagactcgggacatgtctattctccaaaaatcaaattagctcgagcttcgtatggggtatcggcgcctcgtcaggctttacagcctggtcatcgcgcagttctattgaactctcgattgccaggcccaaatgccaaacccgagattctcaaaggtggcgtagtatacgctgacccggcgatatgctcaagtcccgaacagacaaagatcccgatggatcgcgcaaagaatcttaaatccagccgcgttcggcaaaagaaacgtactctccgcgcccaattatcaggtgatcgagcacccggatatccataaactggcaacactttatcacgcgctcagtgataagtttatctgctttacttggctctgcgcagcctgaagggtggttatgcgccagaatgaccgctgaagcattgagtttaatcgcttcccgaacaatctcacgcggatgcacctctacgtggttaagcgtgccggaaaacaggcggctgtgctgaagcacccggtgctgggcatcgaggaagatcaccagaaagatctcacgctcttcgcccgtcagttggctttgcagaaattcccgcgtcatttccggactcagcaacgcactttcctcattcatgcgcacgctgtaatagcgccttgccagctcagcaatgcctttcaactgcgcgaatttcgccaggccgatgccgtttacgccgcgaaactgcgcaaagtccgccgacagcaggccatacagcgacccaaagtgctgcaatatctcttttgccaacgtcataacatcttttcccggcgtgccggtacgtaaaaaaagcgccagcagctccacgtcgctgagggaagcaatgccggatctgagcattttttcacgcggcaataattcgtccaacgtatccatacgcgcacctccttttttaaggaagcggcatagtggcacagcctttgggagagatcgacgccccgattttgttcttgcgtagcgcctcgcaaagtggagcgcaggcaaagacacgacgccgtagagattgtgataaaatagccgcctttcaaagtcacccaacaggaaagacatgatgagcctggccggtaaaaaaattgttctcggcgttagcggcggtatcgctgcgtataaaacgccggagctggtgcgccgtttacgtgagcacggcgctgacgtgcgcgtggcaatgaccgaggcggcaaaagcctttattacccccctgagcttacaggcagtgtcgggctatcccgtatccgacagtctgcttgaccctgccgctgaagccgcgatggggcatatcgagttggggaaatgggccgacctggtgattcttgcccccgcgaccgccgacctgatcgcccgtgtagcatcgggtatggctaatgatttagtctccaccatttgcctggcgacgccagccccggtggccgtgcttccggccatgaaccaacagatgtaccgcgctgccgccacgcaacataatctggaggtgctcgcctctcgcggcctgttcatttgggggccggatagcggcagtcaggcgtgcggcgacgtaggcccaggccgaatgctggacccattagttatcgttgataaggccgccgcgcatttcgctgccgtcaacgatttgcgacatcttaatatcatgattacggcaggtccgacgcgcgaaccgctcgacccggtgcgttatatttccaaccacagctccggtaaaatgggcttcgctattgcggcggccgcagcgcgtcgcggcgcaaatgtcacgctggtctccggtcccgtttcgttaccgacgccgccttttgtaaaacgggttgatgtcataaccgcgctggacatggaagccgctgttcaggccgccgttcaacagcagcacattttcattagctgcgccgccgtggctgactatcgcgcagagactatcgccagtgaaaaaatcaaaaaacaggcggcgcaaggtgatgaattactaataaaaatggtcaaaaacccggacattgtcgccggggtggccgcactcagtgacaatcgaccctacgttgttgggtttgccgcggaaacgaataatgtggaagaatacgcccggcaaaaacgtatccgtaagaaccttgacctgatttgtgcaaatgatgtttctctttcaaatcagggatttaatagcgataaaaacgctttacaccttttctggcaggatggagataaagtcttaccgcttgagcggaaagaactcctgggccaattattactcgacgagatcgtgacccgttatgatgaaaaaaatcgacgttaagattctggacccgcgtgttggtcagcagtttccgctgccgacttatgctacttctggttctgccgggcttgacctgcgcgcctgtctcgacgacgccgtagaactggcgcctggcgcaacgacgttggtacctaccggactggccattcatatcgccgatccatcactggcggcagtcatgttgccgcgttcgggcctgggccataaacatggtatcgtgctgggcaacctggtcgggctgattgattccgattatcaggggcaactgatggtttcgatctggaaccgtggtcaggacagttttaccattgaaccgggcgaacgtatcgcgcaaatggtgtttgttccggtcgttcaggccgaatttaatctggtggaagcatttgacgccaccgaacgtggcgagggcggcttcggtcattctggccgtaagtaaattttacgcatccccataacgtcataatactgccgcaagcgctgagtttgcggttatagcgtgggtgctcgcctggcaagtgcttattttcaggggtattttgtaacatggcagaaaaacaaactgcgaaaaggaatcgtcgcgaagaaatacttcagtcactggcgctgatgcttgaatccagcgatggaagccaacgcatcacgacggcaaaactggcggcctcggtcggcgtttcagaagcggcgctataccgccattttcccagcaagacccgcatgttcgatagcctgattgagtttatcgaagatagtctgattacccgtatcaatctgattttaaaagatgaaaaaaacaccagcacgcgtttgcgcctgattgtgttgctgattctgggttttggcgaacgcaaccctggcctgacgcgcattcttaccgggcacgcgctgatgtttgaacaggatcgcctgcaggggcgcattaatcagctttttgaacgcatcgaagcgcagctccgccaggtgctacgagaaaaaagaatgcgtgaaggcgaaggctacacgacggatgaaaatctgctggcaagccaactgttagccttctgtgaaggtatgctttcacggttcgtgcgtagcgaatttaaataccgcccaacggacgatttcgacgcccgctggccgctcattgccgctcagctacagtaacgctgactggatagtggctcacgccttatccaggcgacagaaacataggcccggtaaagcgccaccgggcaattcgcttacacgccaaattcttcccggtatgctcgcacagccgccagatgctcagccatatcaggtttttcttccagataggcaatcaggtctttcagcgtaatgatggagataaccttacaaccatagtcgcgctccacttcctgaatcgcggaaatctcgccgcggccacgttcctgacgatccagcgaaatcagtacgccagccagcgtagccccgtgcgcctgaataatctccattgactcgcgaatcgccgtacctgcggtaatcacgtcatccaccagcatcacgcggccctgtagcgcgctgcccaccaggctcccgccttcaccatgatcttttgcctctttgcggttaaagcagtacggcaggtctttatcgtgatgttccgccagcgcaaccgccgtcgtcgtcgcgatcggaatacctttgtacgcggggccaaacagcagatcaaattcaataccggaatccaccagcgcttcggcataaaaacggcctaacaacgccaggtcgcgcccggtattaaacagcccggcgttgaagaaataggggcttttgcgcccggatttcagcgtaaactcgccaaactttagtacctgcttgttaagcgcaaactcaataaactggcgctgatacggtttcatggattcgctccttttcttactttcatcatttacgaaatttacggacaaaaaaaaggcgacttttcagtcgccttaaaatcaattttctaacgccgccttctgcgtcgccacaatggattcaattccccctcgggccagcgccaacaaagtgagaagttcttcatggctgaacggctcgccttccgcggtaccctgtacttcaataatacggccgtcttcagtcatcacgacgttcatgtcggtttctgctgcggaatcttcaacatattccagatcgcagatcgcttcgccgttaacgatgcctacggaaaccgccgccaccatgcctttcatcggattggttttcagcttaccgttggcaaccaatttattcagcgcatccgccaacgccacgcaggcaccggtaatagacgctgtacgcgtaccgccatcggcctggattacatcgcagtccagcgtaatggtaaattcgccgagcgttttcagatcgaccgccgcacgcagcgcacgcgcgatcaaacgctgaatttccatagtacggccgccctgcttaccctttgccgcttcgcgcgcgttacgggtatgggtagcgcgaggcaacatgccatactctgcggtgatccacccctggccttgtcctttcagaaaacgtggaacgccctcttcaatggaggcagtgcacaacactttagtatctccaaattcgaccagtaccgagccttcagcgtgttttgtatagttacgggtcagggttacgggacgcacctgattagcgctacggcctgctggacgcatattgagatctccggcttaaaacgaatgtggctgcgcattatacggacttccgatggttattcctatcctgacaaggcctggatagctataatcccctcatctctcctttaaaaacgggaacatctatgatccgcagtatgaccgcctacgcccggcgtgaaatcaagggtgaatggggtagcgcgacctgggaaatgcgctcggtaaaccagcgttatctggaaacttactttcgtctgccggaacagttccgtagtcttgaacccgtcgtgcgcgaacgcattcgtacacgcctgacgcgcggcaaagtcgaatgtatgctgcgttttgaacccgatgccagcgcgcaaggcgagcttattctgaatgaaaagctagcgaaacaattagttagcgccgcaaactgggtcaaaatgcagagcgacgaaggggaaatcaatccggttgatattttgcgctggccaggtgtcatggcggcgcaagagcaggatctggacgcgattgccgcagaaattttagccgcactggacggtacgctggatgactttatcgtcgcgcgcgaaacggaaggccaggcgctgaaagcgctgattgaacaacggctggaaggcgtcagcgccgaagtagcgaaagtccgcgcgcatatgccggaaatcctgcaatggcagcgtgagcgcctggtcgcgaagctggaagatgctcaggttcagttggaaaacaaccgtctggagcaagagctggtgatgatggcgcaacgcattgatgtggcggaagagctggatcgtctggaagcgcacgtcaaagagacttacaacattctgaagaaaaaagaggcggtaggtcgccgtctggacttcatgatgcaagaatttaaccgtgagtcgaacaccctggcctccaaatccatcaacgctgatgtaactaactccgctattgaattaaaagtgttgatcgagcaaatgcgcgagcaaatccagaatattgaataattctggcgctcaatatgtcacagagcccgccttatgcgggctctcgcgtttatcggtagtacgtttttaatttccggcgaatagcgtcgataaggcgtcgcttccactctaccgttgaagcccgatactgcataaaaatagcgccttccgcctgctccccggcaagcggcaggacaaaaagaccgcgcttatcggataaattttcataccaggggcgcggtacaatcgccattagcggcgccgactggacagcaggcgcaagttgactgtaatcatgacaaacaaacgccagcggacgttcaaacccggcacgagcctgctgcctgtccagttcgttgttctcttttgtccacggcaaacagtaaatgtgttgataatgctgtagatcagcaaaattcaacgctgtggcattctccagacgtgaacgcaatggcgcgccataaaccgcgatcaaacgcgtagtccccacccgctcgtaatgcagagcgctgacctgcttttgatggtcgccaattgccagcaccaaatcaaccgagctatccaacagttcatcacgccagggtcggcgggcaaaaggaaggcactcgatcaccgcctgatgaagatgacctttctctgcgagaactggcgtaagcagcgcgttcaatgcgggaggaagtaccacccgaaaacaacgggagccgttctctttatcgccaaacagctcctcattaagcgaaacaaacacaggcgccaatttgtcacgcagcgcctgcgcataaggcgtaggaatctggcggttcccttcccgtcgaaacaacgggtcgtttagcgcatcgcgcaatctcattaacgcatgacttaccgcagaaggcgacaaagccagcttttgcgccgttttccccgtagagctcgtctccagcagcacatacagtacttttaacaggttcatatccatttgcagcaagttcattaaacgtctctcttattgaacctggctaaattactgccaggtatactgcgggcgcttcaatcaggagaacattatgaatcgctatgcattattccttgtatgtatattttcaacatcagcacttcctgccatggcggcattagatccttcacaaccgttatcacccgcgcctccgttatcactgtttaaagcgtgggctaagcctataaagccgtttcaaatcacagaaggcgtgtggtatgtcggtacgaaaaatctctcttctattctgctgaccactccggcagggcatattcttattgatgcggggttggatgaaagcgcaccgcaaattaaagcgaatattgaagcggcaggattccgcctcacagacgtgcgctatctgttgaatagccatgcgcggctggatcaagcggggggcatggcacgtttgaaagcgtggagcggcgcacaattggtcgccagccaacccaacgccgatcagatggcgaggggtggacgacaggattttgcgcttggcgatgcgctcccctttccgcccgtcaccaccgataaaattatccaccaccaggaaagcatcatcctcggagggataaccgtgacagcactattcacgcctggacatctgcccggctcaacttcctggcgcgtaacgctccgcaacggcaagacgctaatttacgcagatagtctcgccacgcccgactatctgctgattaacaacaaaaattaccctgacctggttactgatattcagagcagctttaagacactggccgcccagcatgttgatatctttattgccaacaaaggtgaccgcttcgggctactggagaaacgacagcaacttcgcaacggcgatacacaggcattctttgattccaatggcttgcaacagtatgtggaacgctcgcgccagcgcttcatcacacaacttaccgcacagcagccataatgaaataactcaccggcggcgcgtccagggcgccgttcttttaaattatctaagtcaaaatagaaaaacctcgcatacaataaaccacaaaaatgatgttcaatttattgatatttataataaataattattaattataaatttaaaatcattactaaaatttattaatcgtgtaatgccttagaaaatctcaatcgtgatacagcgcacaaatcgttaatcttcgcccccagtaaattagggggaaatcatgctgttgcacgttctttatttaattggcatcactgccgaggccatgacgggcgcactcgctgcgggtcgtcgtcgcatggatacattcggcgtaattattattgctaccgccaccgccattggtggaggctcagttcgcgacattctgctcggtcactatccgctgggttgggtgaagcatcccgaatatgtcattattgtggcgactgccgctgtattgaccaccattgttgcccccgtcatgccctatttacgcaagcttttcctggtacttgacgcgctggggttggtggttttctctattattggcgctcagatagcccttgatatgggcgaagggccaattatcgccgtggtggccgccgtcactactggcgtctttggcggcgtgctccgcgatatgttctgcaaacgcattccactggtgtttcaaaaagagctatatgccggcatttcgttcgcctcggcggtgctctatattgcgctgcaacattacgtcatgaatccggatgtcgtcgttatctctacgctactgtttggctttacagcaaggttattagcgctacgtcttaaacttggcctgccggtattttattaccgccatgaagggcactaagacccaaatccgggaatatgctgagcagccagccatctgctcagcgctttgatctgcagattattccgccagtcgatgactctcccggcacgacgctcgcccgtcgctggtaactgccgccagtgttgctctgttcgcattaataactgctcccatgaacgatcgccgctggcctgtaatgcagcctgcgttaaggggatatccatcgccatgatccagcgggtaaacggctgccggcgcgccaggttaaattgccgccatatctgctcgctttttcctttagcaaagcctggcgtgttggctatttgcgctgacgtcagggtaagccaggagaagatatgctcaaagcgatgcgtctgatgcaaggcccgccagctggcttcacccattccgtccagacccaacgccgaccgtgaccccagccatatcagcctggagataaactgttcctgacacgttgccgacgcgtaaaagcaggtcagcgagttgaaatggctatcaggcggtacaggcttactccgctcacgactccgccagacgacctcatcaagccggggaatgccttgcccggccagactcaccaggatctgatcgcccggcgcgatatcccacgcttcccaacgtttcacagaaccgatattgacccgctgaacccgcttatcatccaatataacggggacaagcgacgctactacggtaattttgccgcttttccccaccgagaactgaatagcgctcacttgcgcgacctgcgctactggcggatatttccatgctgccagccagtcgccctgcccgggtcgccagtgttgtgacgcaggttctttagccatgcgtatcactacgccatccgttacaaagggtaatgctgacgtcagccatgactggcgcgcccgctcgacctcgctggcatcttttaccgccagggtatatttattcgtcagactgaatccagccttagcaagttggcttaatctttcgggcatatttgccggaccgtccggccacgcccaaataaaaatacccaacgaatttagcgcggaggcgttatcctggcgcattaacattcctgcgactttcgagcgcgcattcatcccgcccatccgttgctggatatgtccctcgcgctgtagaaagatttcgccctgtaacaccgcgttagcaagcgcgccttgtgttgtctgcggtatagaggggatcaggcgaatttttggcgtccagtcctcgccttgtagtccgttaccccggctaatggccctggtcagtttaccgttttgataaaccagtgttaccgctacgccatccacttttggctgtacccaaagctcgctgcgcccgcgcatccactgttctaccgcctgtcggtccacgagtttacgtacgcccgtgtgcgcaacagggtgcattgttgtaccgtttaacggcggtgaaaccggagtagatgaaacatcctgaccaacacagcgttgccactgaaccagccttgcgctgagttggtcgtacacactatcgtcaaccgcgctaaccccttgtttccagtagatgtcattccagtcagcgagctgttgctgtaaacgggcgatttcttcagcggcccttgctggcggccaggccgggcaaagcgccccactctgcgaatgccacaataaaattccccacgccatacttttccataatctcatcacgacctcctgcgcacattgcccggcaggtatagcgctttagtgaataaaaaccgacaggtaaaaatgcatcatccgagccgctttccagattttttggtgggttgctgcaacgacgcgataaaagcggaaaaagggacgcaaaatgcaataatctggcgcaaaaagtgtgacaaagactacgtcgcataacggcgatgtgtataataagcccgtatcaaggctctatttcgataatcacagacgtaagatactcatggctcaaggtacgctttatattgtttctgcccccagtggcgcgggtaaatccagcctgattcaggctttattaaaaacccaaccgttgtatgacactcaggtttccgtttcacataccacgcgcgcgccgcgtccgggtgaagtgcacggtgagcactatttctttgtaaatcatgatgagtttaaaaccatgattggcagggaggcgtttctggagcacgcggaagtgtttggcaattactacggcacttcgcgcgaaaccattgagcaagtgctggcaaccggcgttgatgtttttctggatatcgactggcagggcgcccagcaaattcgcgaaaagatgccgcaagcacgcagcatttttattttgccgccgtcaaagatcgaattggatcgccgtttacgcggccgcgggcaagatagcgaagaagtcattgccaaacgaatggcgcaagcggttgcagaaatgagccattacgccgaatatgattatcttattgtgaatgacgactttgataccgcgttaagcgacttgaaaaccatcattcgcgctgaacgtctgcgtatgagccgccaaaagcagcgtcataacgctttaatcagcaaattgttggcagactgaacccactttcagtatcatgcccagtcatttcttcacctgtggagcattttaagtatggcacgcgtaactgttcaggacgctgtagagaaaattggtaaccgttttgacctggtactggtcgccgcgcgtcgcgctcgtcagatgcaggtaggcggaaaggatccgctggtaccggaagaaaacgataaaactaccgttatcgcgctgcgcgaaatcgaagaaggtctgattaacaaccagatcctcgacgtccgcgagcgccaggaacagcaagagcaggaagccgctgaattacaagccgttaccgctattgctgaaggtcgtcgttaatcacaaagcgggtcgcccttgtatctgtttgaaagcctgaatcaactgattcaaacctacctgccggaagaccagattaagcgtcttcggcaggcgtatctcgttgcacgtgacgctcacgagggccagacacgttcaagcggtgaaccctatatcacgcacccggtggcggtggcctgtattctggccgagatgaaactcgactacgaaacgctgatggccgctctgctgcatgacgtgattgaagatacccccgccacctatcaggacatggaacagcttttcggtaaaagcgttgccgagctggtagagggggtgtcgaaacttgataagctcaagtttcgcgataagaaagaggcgcaggccgaaaactttcgcaaaatgattatggcgatggtgcaggatatccgcgtcatcctcattaagcttgctgaccgtacccataacatgcgcacgctgggctcgttacgcccggataaacgtcgtcgtattgcccgtgaaacgctggaaatctacagtcctctggcgcaccgtttaggtattcatcacatcaaaaccgagctggaagagctgggttttgaagcgctgtatcccaatcgttaccgcgtcatcaaagaagtggtaaaagcggcgcgcggcaaccgtaaggagatgatccaaaaaatcctctctgaaatcgaaggacgtttgcaagaggcgggaattccgtgtcgcgttagcggtcgcgaaaaacatctttactcgatctactgcaaaatggtgctcaaagagcagcgttttcactcgatcatggacatttacgctttccgcgtcatcgttcatgactccgatacctgctatcgcgtactcggccagatgcacagtctctataagccgcgtccgggacgggtgaaagactatattgccattcccaaagcgaacggctatcagtctttgcacacctcaatgatcggcccgcacggcgttcctgttgaagtccagatccgtaccgaagatatggatcagatggcggaaatgggggtcgcggcgcactgggcgtataaagaacacggtgagaccagcaccacggcgcagatccgcgcccagcgctggatgcagagcctgctggagctacaacagagcgccggtagttcgtttgaatttatcgaaagcgtaaaatccgatctcttcccggatgagatttacgttttcaccccggaagggcgcattgtcgaactgcccgctggcgctacgccggtggattttgcctatgcagtgcataccgacatcggccacgcctgcgtcggcgcgcgtgtcgaccgccagccttatccgctgtcgcagccgcttagcagcggtcagaccgtcgaaattattaccgcgccgggcgcgcgtcccaacgccgcctggctgaactttgtcgtcagctctaaagcgcgcgctaaaattcgtcagttgctgaaaaacctcaaacgtgatgactccgtaagcctgggccgtcgtctgcttaaccatgccttaggcggtagtcgtaagctggcggaaattccgcaggaaaatattcagcgcgaattggatcgtatgaagctggcaacgcttgacgatctgctggcggaaatcggtctcggcaacgcgatgagcgtagtggtcgcgaaaaatctgcagcaaggcgaagccgtggtgccgaccgttgcgcaatcgaatcacggccacctgccgattaaaggcgcggatggcgtgcttatcacctttgcgaagtgttgtcgtccgatcccaggcgacccgatcatcgctcacgtcagcccaggtaaaggactggtgatccaccacgaatcctgccgtaatatccgtggataccagaaagagccagagaaatttatggcggtcgaatgggacaaagagacggagcaggaattcattaccgaaatcaaggtggaaatgtttaaccatcagggcgcgctggctaacctgacggcggcgattaataccaccacctccaatattcaaagcctgaatactgaagagaaagatggtcgcgtctatagtacctttattcgccttaccgcacgcgatcgcgtacatctggcgaatatcatgcgcaaaatccgcgtgatgccagacgtcattaaagtcacccgtaaccgaaactagcgctatgaatccaaaacgttatgcgcgtatatgcgaaatgctcgccaggcgtcagcctgatctcacggtctgcatggagcaagtccacaaacctcataacgtttctgcaatcattcgtaccgcagatgccgttggcgtccatgaagtccatgccatctggccaggtagccggatgcgcaccatggcttctgcggcggcgggcagcaacagttgggtacaggtgaaaactcaccgtaccattggcgatgcggtagcccatttgaaaagtcggggaatgcagattctggcaacccatctttctgataaggccgtagactttcgcgagattgattacacgcgcccgacctgtattctgatgggtcaggagaaaaccggtattactcaggaagcattagccctggcggatcgggatatcatcattccgatgatcggcatggtacagtcgctgaacgtttccgtcgcctccgcgctcattctttatgaagcccagcgccagcgacagaacgcgggcatgtatctgcgtgaaaatagcatgttgccggaagatgaacagcagcgcctgctgtttgagggtggttatccggtgctggcgaaagtcgctaaacgtaaaggtctgccttatcctcgcgtcaatcagcagggcgaaatcgacgccgatgctgactggtgggcgacgatgcaggcggcagggtaatcaccatgtcaggccgcttgttagacgctgttccgctcaattccctgacaggcgtcggcgcagcgcaaagcagtaaactggcgaaaattggcctgcacaccgtgcaggacctcctgctccacctccctctgcgttacgaagaccgcacccatctctaccccattggcgaactgctgcctggcatctacgccaccgttgaaggcgaagtgctgaactgcaatatcactttcggcggtcgtcggatgatgacctgccagattagcgacggttccggcattcttaccatgcgctttttcaattttaacgcagcgatgaaaaacagcctggcgacgggacgacgtgtgctggcctacggggaagcgaagcgcggcaagtatggcgcagagatgatccatccggaatatcgcctgcagggcgatctcagcacgccggaacttcaggaaacgctcacccccgtctatccgaccaccgagggcgtgaagcaagcgacactgcgcaagcttaccgatcaggcgctggagttgctcgacacctgcgccattgccgaactactgccgccggaactggcgcagggtatgatgagcctgccggaggcgctacgtaccttgcatcgcccgccgccgacgctccagctcgccgatttagaaaccggcaaacacccggcgcagcggcggcttattcttgaagagctactggcgcataatctcagtatgctggcgcttcgcgcaggcgcgcagcgctaccacgctcagccgctaagtaccaacaacatattgaaagacaagctgctggcgtcgttgccgtttaaacccaccagcgcgcaggcgcgggtggtagcagagatcgaacgtgatatggcgctggatgtgccgatgatgcgtctggttcagggcgacgtgggttccggtaaaacgttggttgcggcgcttgccgccttgcgcgctattgcccacggtaagcaggtggcgctgatggcgccgaccgaattgctggctgaacagcacgcaaataatttccgcaactggttcgaaccgttgggcgttgaagtgggttggctggccggtaagcaaaaaggtaaagcgcgtcaggcgcagcaagaggctattgccagcggtcaggtgcagatgattgtcggcacccacgctatcttccaggaacaggtgcagtttaacgggctggcgctggttattatcgatgagcagcaccgctttggcgtccaccagcggctggcattgtgggaaaaaggccagcagcagggctttcatccgcatcagttgattatgaccgcaacgcccattccgcgcaccctggcgatgactgcctacgccgatctcgatacctcggtgattgacgagctaccgccgggccgtacccctgtcactaccgttgcgattccggatacccgtcgccatgaaatcattgatcgtgtgcgcaacgcctgcacaaccgaaggccgtcaggcctactgggtctgtacgctgattgaagagtcagacctgctggaagcgcaggcagcggaagccacctgggaggagctcaagctggcgttaccggagttgaatatcggcctggtacacggccgcatgaagcccgccgaaaaacaggcggtgatgcaggcctttaagcagggcgaactgcatctgctggtcgccactacggtgattgaggtgggggtcgatgttcctaacgccagcctgatgattattgaaaacccggagcgactgggcctggcgcagttacaccagctcagagggcgcgttggccgtggcgcggtcgcatcgcactgcgtgctgctctataaatcgccgctgtcgaaaacggcgcagaagcgtttacaggtattgcgcgacagcaacgacggctttgtgattgcacaaaaagatttagagattcgcggcccgggggaattactgggcacgcgccagacgggtaacgccgaatttaaagtagctgatttgctgcgcgatcaagccatgatccccgaagttcagcgtattgcccgtcatattcacgaacgttatccacagcaggcacaagcgctgattgagcgctggatgccggaaaccgaacgttattccaacgcctaatcctattcgccgcgcgacagagccaacagaagatcctcaatctggatagcgataacgtcctgggctgccagggcatcgcgcgagatacgcgttgccatcgcactctccggctcgtcccgcagcatttccgccgccttctgcaccccgtcgaggatcatctccgacgttaactgccgggttaaaaacgccagattattttccaaccacggttcttccgtcgcacctaatggcggttgccactgccacgagccttctggccaaagcgggttaacctctaccggataaattaaatgtgcggcgtactgcaacgcgcataccgctttacccggcgtatccagtaaccaccactgattccagagcgaacggataaacggcgcaatgccgccgagaacattgaaggtatccagccaggtcagcggagagttgaaaccgcgctcgtgattgattcgcgccagcatggtctccagcaaaaaatgccgtacctgctgacgctgagcggcatccatcatttcccgccagagataaggccgccgtaacgcacgcaggaaagactcctcgaagtgatcgccatagccatgggttaacagcgtttcgcgccaacaggcaaggcacagcggaaacagataacgaaacaattccggctgcatcggttcgtggtaaaccagattcagcacataataaacgctcagatgccaatcggtaatctgccgccagtccgtcgccgccagcgcctgcaactcagcatcggcatagtcaaactccgcttcccacacgttaagaaccggcggctcatcgccaaaaatatgacggcagcgttcacgcagggtttcaggttgacggcaacgttttttcatctttatccggcaaacattggcagcatcaggtacagcttgatcaccaacgcattgacgatatcgataaagaacgcgccgaccatcggcaccaccaggaacgccatatgcgaggggccaaaacggtcggtaatcgcctgcatattagcaatggcggtcggcgttgcgccaaggccaaaaccgcagtgacccgccgccagcaccgccgcatcatagtttttccccatcatgcgccaggtgacgaagatcgcgtacagcgccatgaagatggtctgtaccaccagaatcgccagcatcggcagcgccagtgacgccagttcccacagcttcaggctcatcagcgccattgccagaaacagtgacaaactcacgttccccagcaccgaaacagcacgctcaaatacgcgataaaaacccaccagcgccaggccattgctgaggatcaccccaacaaatagcacacaaacgaagaccggcagttcaagcaccgttcccgccagtagctgcgctacgattttgcccacggtcaaacagatagcaatcagggcgatggtttcgattagcaccagagaggtgatcatacggcccacatccggcttttcaaaggctgtcggcacggcctgatcgtcaggcattccatccggcgtggtggagtgtttcaccagataacgcgctaccgggccgccaatcaacccgcccagcaccaggccaaaggttgcacatgccatcgcaacttcggtggcactggcaaaaccataacgttcgacaaacagtttactccacgccgcgccggtaccgtgtccgccggacagcgtaattgacccggcaatcagccccattaacgggtccagccccaacagactcgccatgccgataccgatggcattctgcatcagcagtaatccgaccacgacgaccaggaagacgccaacaacgcgtccccccttgcgcaggctggcaaggttagcgttaaggccgatcgtcgcgaaaaacgccagcatcaacggatcgcgcagggtcatatcaaagttgacctcccaaccgacgctttttttcagtaccagcagagcaaccgcgaccagtaatccccccgccaccggttccggaatcgtatatttcttcaataaggagacagactggaccagcttgcgacccagtagcagcaccagcgtggcggcgacaagggtcgataaggtatcgagttcaaacatttaaagctcctgtagtgcgctgtgacatgtgcgcacaaatcatttcctgagtcagttttttagctctttgcgagtcttcggcatggattttaagcagaaaaaggcaaaaagttatataaaaaggtgcatttatcttttttaaatattaagaatattcgctcgcaatcgtttgcttttaccatctggtcagataaaatcaccgcttttccaccacgagaatgtccctgatgtccgttaacgccatcgagccggcagatgcgcaaccggttgcgcagacgcaaaacagcgaattaatttaccgtcttgaagatcgcccgccgctccctcaaaccctttttgccgcttgtcagcatctgctggccatgtttgtcgcggtaatcacgccagcgctgttaatctgccaggcgttgggtttaccggcgcaggatacgcagcacattatcagcatgtcgctgttcgcctccggcgtagcctctattattcaaatcaaagcgtgggggccggtaggatcggggctgttatccatccagggaaccagttttaactttgtcgccccgctgattatgggcggtaccgcgctgaaaaccggcggcgcggacgtcccgacgatgatggcggcgctgttcggcacgctgatgctggcaagctgcaccgagatggtgctttctcgcattctacatctggcgcgccggattatcacgccgttagtctccggcgtcgtggtgatgattattggcctgtcgctgattcaggtggggctaacttccatcggcggcggctatgccgccatgagcgacaacacctttggcgcaccgaaaaacctgttactggccggcgtcgtcctggccattatcatcctgctgaatcggcagcgtaatccctacctgcgcgtggcttctttggttattgccatggcggcaggctatcttttggcctggtttatgggcatgttgcctgagaataacgcgccggtctcacaggacatcctgatggtgccgaccccgctgtattatggtctgggcattgactggaacctgttactgccgttgatgctggtctttatgattacgtcgctggagaccatcggcgacatcaccgccacctctgatgtctccgagcagccggtatccggccccttgtacatgaaacggctaaagggcggcgtactggctaacggcctgaactcatttgtttcagcggtatttaatacgttcccgaattcctgtttcggtcagaacaacggcgtcattcagttgaccggcgtcgccagtcgctatgtgggatttgtcgtcgcgctgatgctgattgtactcggcctgttcccggcggtaagcggttttgtgcagcatatcccggaaccggtgctcggcggcgccacgttggtgatgttcggcaccattgccgcctccggggtgcgtattgtctcgcgtgagccactgaaccgccgcgcgattctgattatcgccctgtcgctggccgtgggtcttggcgtctcgcaacagccgcagatcctgcagttcgcgccggaatgggtgaaaaatctgctctcatccggaattgccgctggcggcatcacggctatcgtgctgaacctgattctcccgccggaaaaaccgtaaaaaccctgcggcggcgacacgattcgccgctgctgtaacgctctttcaccattcctgtcttgaggattgcacgcaaatcgtgcataaatcccctatgtgcatttcacgggatggaagaccatgaaattgattgggaggttgcttctctacgtgctgatcgcctgtttagtggtgattttcggcttttattttctgctgcaaacgcgctggggcgcagatcatgtcagcaactgggtatcagagaacagcggttatcacctcacattcgacgtgatggatcatcgtttttccgccccatcccatcttttactggagaatgtgacctttggtcgtgatggtcagcctgctaccctggtcgcgaaaaccgtagatatcggtctgagcattcgccagttaaccgcgccgctgcatgtcgacacgattctgttacaggacggcacgctgaatatttcagtgcaaaccgcccctttcccgtttgaggccgaccgcctgcaacttcgcaatatggcgctcaatagccccggtagcgaatggcgattgagcgcccagcgcgttaacggcggcgttatgccctggcgccccgaggccggtcgggtattgggcaataaagcccagatccaactgagcgctggttcgctgacgttaaacgacgttcccgccacgaatgtgcttattgaaggcagtatcgaccataatcaggtgatgttaaacaccgtcggcgccgatatggcgcgcggagcgttaaccggcgtcgcccggcgtaacgctgatggtagttgggtcgttgaaaatctgcggctgaatgatattcggttacaaagcgataaatccctgagcgagtttttcgcgccgcttactacggttccatctttgcagattagtcgtcttgaagtgacggactccagcctgcaaggaccagactgggcagtcaccgatcttgacctgagtttgcgcaatctgactctgcgcaaagaagactggcaaagccaggaaggtaaattatcgatgaatgccagcgagtttatttacggctcactgcacttgctcgatccaatcctgaacgccgaattttcaccacagggcgttgcgctacgccagttcactacccgctgggaaggcggtatggtcagaacttccggcgcctggttacgcgaaggcaaagcgcttattctggacgataccgctatcgccgggctggagtatacgctgccggaaaactggaagcagttatggatgaagccgctgcccgactggttgaacagcctgacgctgaaaaaattcagcgccagccgcaatctggtgattgatatcgacccggccttcccgtggcaaatcaccgctctggacggctacggcgcaaacctggagctggtacaacatcatcaatggggcgtctggagcggcaatgcgaccctcaacgccgcagcggcaacctttaaccgtgtggacgtgcgccgcccgtcgctgtcgttgacggctaatgccagcacggtcaacatcagcgatctgagcgcgtttactggaaaagggatactggaagccactgccagcgtatcgcaactgccgcagcgtcagacgcaaatcagcctgaacggacgcggcgtaccaatggatgtgctacagcagtggggctggccggcattaccgattgctggcgatggcaatattcagctcacggccagcggcaatattcaggccgatgcgccgttgaaaccgacggtaaacgggcaattacacgcggtcaacgcacaaaagcagcagataacacagacgatgcaagcgggcgtggtgtccggcggggaagttacgtcaacggagccaacgctgtaattgagggcttgcccggtggcgatggcgcttaccgggcttacggttcttgctcatttgtaggccggataagcgcagctcacggcgccatccggcgattcagatttaaagcgtaatcaccacttcatttccctgcggggtgaccactacgcccagttcacttcccgcatatgagccgcatttggtaccgctaatctgcgtaatattacgcagacacagcgtccagttgcgcgccttgccttcgccgctcaccgtaatggtattgcctgtgcgtttcgcctgcagcgtaaagattgtcgaaccatccgtagcagggacttcgcagaccgcttcgcagccgtcatccagatggaataactggaaggccgtaccctcatgccaggcgtaatcgggcttctggctattgttgcccagcgccagtagtgtattgtcacgcacgtacactggcagactcaggaagtcatgctgctgtttatgccagcggctgccctgcacttcatcgttgcgccacaggtgcgtccagcggccttctggcaggtagaactccacgtcgcccgcttcactaaataccggcgctaccatgaccgcatctcccagcatgtactggcgatcaagataatcacacgccggatcgtccgggaactccagcatcatcgcccgcatcattggcgtaccggcttcgttggcacgcgccgcttcccgatacagatacggcatcatccggcacttctgttcagtgaagaagcgcaccacgtcacaggactcgtcgtcataggcccacggaacccggtaggatttgctaccgtgcaggcggctgtggctggagagcaagccgaatgcgcaccaccgcttgtagacatgcgccggcgcggtattctcgaatccgccaatatcatgactccagaagccaaaccctgacaggccgatggacagcccgccgcgcaggctttccgccatcgattcgtagttggcgtagcagtcgccgccccagtgcaccgggaactgttgcgcgcccaccgaggcggaacgggcgaacagcaccgcctcttcaacgccgacggtctctttcagcacgttccacaccagttcgttgtagatgtaggcataatggttgtgcattttctgtggatctgaaccatcaaaccactgcacatccgttggaatgcgttcgccgaagtcagttttgaagcagtccactcccatctccaccaggcccttcagcttgtcggcataccattcgcaggcttgcgggttggtgaagtcgtaaatcgccagtcccggctgccatttatcccactgccacaaggagccgtccgggcgttttagcaaatatcctttctctttcagctcctggaagaccggggatttctggccgatgtaggggttaatccacacgcagactttcagccctttcgctttcaggcggcgaatcatccctttcggatcggggaaagtcaccgggtcccattcaaaatcgcaccactggaaggccttcatccagaaacagtcgaagtggaagacgtgcagcggcagattgcgctcggccataccgtcgataaaactgttaacggtcgcttcgtcgtagttggtggtgaatgaggtggtcagccacaggccaaacgaccaggcgggcggcagcgccggacgacccgtaaattgggtatagcggttcagcacgtctttcggggtcgggccgtcgatgacgaagtattccagatactcgctctcgacgctgaactgaactttggagactttctcggagccaatttcaaacgacacgcactgcggatgattcaccagcacaccgtagccacggttggtgatatagaacgggatattcttgtacgattgctcggtgctggtgccgccgtcgcggttccaggtctccaccgtctgaccgttacgcaccagcgcggtaaagcgctcgccaagcccgtagacggtgtcgcccacgccgagatccagacgctcgaacatgtagttgcgcccgctattggtgtcctgcacatagccgttatttttcaactgactaccggtgatacgtacaccgttacgcagaaaatccagtgaccagatctcgcctttggtgacgcgcacgctcaggctgccgctcttgagttcggcaaattcggcgttgttctgcatctccacgttgatatcttgcaagacattgagcggataatgtgggccgttatccaaagcgccctggaagtgttccatccgtacacctatcactccttcctgcggcgagaaaaagcgtagggtaaacaacggggtatccagttgccaggttcgttcgcggacatcacgcggcgcggcatagatcaccatctcattcccgtgctgttcaacgtcgaacacctgaaccgggtgaatcaaattaaggccaggctggatcagccagtttccgtcgctaattttcatagtctgttcctttagttctgcaattctttatgggtaaattcttgttcattacggtgtgcgccctgcgccagttgttccagaatggttttcaggaacgggcttttcagggtgtagtagcgtttagcgatcgcggcgctcagcagataacagatggccgggacgatagtgaacagagcgatgatgatgctgatcgtggcgctgttttgcgttttcgccgccgcgtcgtaaccgccgcctgccagcatccagccaatcagcgccccgccgagggcaagacccagtttcagcacgaacaacgtgccggcaaaactgatccccgtcaggcgtttgccgttacaccattcgccatagtcgacggtgtcagacatcatcacccactggataggcgtgactaactggtgcaatacgccaatcacaaagataaagacgaacatagcgatcgtggcgtgcatcggtacgaagaacatcgccacgctgattactgcgagtaaagcattggtccaccagaaaacgctcactttgcatttccagtcggtcaacggttttgccagcgccgagccaatcaggttgccgacgcaataggtggtgaggaaggcgacaaacacgcccggtttgcccaatatccaggtgacgtaatacatcatcgccccgccgcgcacgcataccgccagaatattcaggatggtgagcaggccgactatgcgccactggtcgttgtgccagatatcacgcaggtcttcacgcatggaggtatgggtggcaggcgcttcaacgcgctctttggtggtaaagaagcagaacgccagcatcaggaacgccaccaccgagagcgccgcgatacccccctggaagcccagcgccttattctcgccgccaatcagtttcaccagaggcatcatcagtacggtagaaagcattccgcccgccgttgccagcacaaagcgccaggattgcagggagatacgctgcgttgggtcattggttattacaccccccaacgcgcagtaagggatgttgaccacagtgtacagaagggtgagcaacgtgtaggtgatggcggcataaatcattttgccgttcagactgagatccggcgtgctataagccagcacacaaacgataccaaacggcaacgcgccaaacagcacccagggtcggaatttgccccagcgagagcgggtgcggtcggccagcaggcccatacaagggtcggagatggcatcaagcgcacgcgccagtaaaaacatggtgccaacaaaaccagcgggaatgccgaaaatatcggtatagaagaacatcatatataacatgacgttatcaaagatgatgtggctggcggcatcgcccataccatagccaatcttctccttaacggagagaatttcacttttcattacgcatccttaacgctcacaacgctcactaataccggttacagtttttgtaaaccttccctgcgagcgtgaatattccgttatttggttatcaaattacgattcttgttttctgtgatcagggtagcgtcaaaaagtgtgatgaaatgtaactaatggattttatgggggtttatatgaaaccgatcatggcagaaggaaagggaagttaaaaaagcacgggaggggatgtggaaacgccaggaagtagctataatgcgcgcgcctccatgtagcaatcgaggcgcggaagatcgtcgtctccggtgaggcggctggacttcaaatccagttggggccgccagcggtcccgggcaggttcgactcctgtgatcttccgccaacatccttctctcatgcccaccattcgtcctctatttcgggacaaagtatttgcttattattaagactagttcttgcatataatacgaaaggaaaggtggatagagaaagtggaatattattttattaatcaccatttaccgattgctaaaaccgaacgtccatttattgtgggatatcgtctgcaaagaagggataaaagtacgccaggactaacgcgggcgggacttaactaatcaccaaacgaacttgtgggtcatacttacaggctcatcctttctcaaaagagatacgcttaccaggccaaaattatgagatcaacgtatagagccatccggataaagatacatgcctccctccagatacacgggttctccttcttctaccgctaaattatgatatagcgattgcatttcatcatctgcactttcttccggttggttttcaactcgataataggtatctacatcatagttctgtttacggagatcgtcgtcgctgtatacgccaagccgtttttttaagcctgttatattaaatatccattttaacccatctttaatataataggcatcaccataagcattttcatcggggcattctttatagcccatccgcaatgcaacatcacagccatgcttaccaacatatttataactcatatcccccccaatatgttgcttcaatatcccagataaaattcataacgaaaacctatcctgataacctatgccacatgaaggatacaatttaaactaaagtacgcgttatattatcccctaagtccgtatcaagtatgcgtattctgtagtaggtagtaatatgttctaatttattaatgtgagttatatatgaagagattatttacagcgatgattatcgcttttattaccgtcacggcatcatccagtgcgcttgcctgcccaaagggtcaacatccacatgggggtacaggctcacatcataagggtggatggtgttcatacgagcagtaacgtcgcagcttactcatctacttgaaggcactatagccttacgtttatcaacgcaggcgctacgtttgtcgatgccgtaactttctgaagaaaaaacatgaacgagttggtatcgatcgcaaagaatatggttaccaacaacagtcaccttgtctccaggctgtcgatattctacggacacgacaggaaaggattttattaattccttagaaaaaccatgttaatcaacaggataaatagttaaaacgtgataaaaggcgtaacctttgcccgcttaaagcgggcaagattgcaggcaagagatgttattatactaaaacataaaaacaggtgaggctggtgtaatgagaatcgacaaactttcactgcttaactttcgttgcttcagacagctcgatattacttttgatgagcacattacgattctggttgcaccgaatggcgcgggcaagacgacagtgctggatgcgatacgcctggcgctgtttccctttattcgtggttttgatgccagcctctacgtaaaagataaatcgctggcgatccgtacagaagatgtacgtctggttttccgccccgaagcgctgaacatggaaatgtcgtctccggccatgattacggctaccggggaatgggaaagtggaaaaacggcaacctggatgctcgacaagcgaggagaacagccgccgcatgaagataagacagcggcgcagcttacccgttggggtgaacaacttcagacgctggtgcgtgaagagcataatttgcagcaggttgagcttcccctaatgctttatctggggactgctcgcttgtggtatcaggaacgttatgaggcacagcctactgaacagcgtctggataacagcgccttttcacgtttgtctggttatgacgattgcctttctgccacatcaaattataagcaatttgaacaatggtatagctggttatggcttagctaccgtgaacatcaaatcacacaacttgaatcaccttcagcaaagttaaaagaaggtgttcgtgttcagcggatgaaagaagctattcaagccatccagcaagccattaactgtctgacgcaggaagtgactggctggcacgatctggaatacagctccagccataaccagcaattggtgatgaaccatccacagcacggtaagattcccttatcccagctcagcgacggcctgcgtaatgcggttgcgatggtagcggatatcgcgtttcgctgtgtcaaactcaacccccatttacgcgatgaagccgccttaaaaacacaggggattgtgctgatcgatgaagtcgatatgttcctgcacccagcctggcagcagcaaattatccagtctttgcgcagcgcatttccactaatccagtttattgtcactacccatagcccgcaggttatcagcacggtaaaacgtgagtctgttcgcctacttgaacaggacgagaaaggtaatggtctggcgtcaataccagcggggcgacctacggcgagccaagtaatgatgtactgcacagcgtgatgggcgtcgatccgcaacctccggttaaggaacaggatgttttcgaacgtgggattatcaatgtatttaaggggttaagccaggagtacaaaaccaataatccttgttatttcggcaagaagattatcgtcaacaatctggtgaagcatgaccgatggggctacagcctgaactggggctggcgacgcgaccagctcgccgatctggaacgaatactctacctgctggatagtaaaaccattcctgacaaccggcatgatgtctctatccggtttatggacttcgtgcgcgataatccgcgtgagcaggtctttgaagacgatatgttcaccatccgctacttttagaagggcagcggacatatcacatttaagcgtctggatctggtggagaatatgaatgatatcgtggcgaagcattatccgggggcgctgcccgcaaaataaacgctatctgcgtaataagcttcaccaggaatttctggcatactaggcagattacggcattgcgagtcagatataagcggaggcggcatggcagacaaatacttaacccaatccccggcaggcgaatttgttatgtttgccagcgatgacggtgaagttcgtgtggagtgccgctttgagcaagagacgctatggctccctcaggcaaccatcgccaacctttatcagatcactccccaggcagttacacagcacattaaagcgatctatgaagaaggcgaacttgagcaaaacgcaacctgtaagtcttacttacaagttcaacaggaaggtagccgtcaggtaagccgcaacaggcttcactacagcctgcctgtcatccttgctgtcggctaccgcgttcgttccccgcgcggcacacagttccgccagtgggcaacccagacgctccagaaatacctgatcaaaggttttgtgatggacgatgagcgcctgaaaaatccgcccgtgggttcatcggctgtacccgactattttgatgagatgctggagcgtatccgcgatattcgcgccagcgaacgtcgggtttatttgcgggtacgagagatctttgcgttagccgccgactatcaaccatcgctcaaagaaaccacgcaattttttcaaaccatccagaacaagttgcattttgcctgtaccggacataccgctgctgaactcattcatcagcgtgctgacgccagccagccgcatatggggctgaccagctataaaggtgaagaggtacgtaaggatgacgtgacggtggcaaaaaattatctcactcaggatgaagtcagcgagcttaaccgcgtagttaacatgtggctggattttgccgaggatcaggcccgtcgtcgtcagcagatctttttacgcgactggcaggataagctggatcagttcctgcaatttaacgaccgtgaggttttacaaggcgcaggtaaagtcactaagaaaatggccgatgaaaaagcgcaggcggaatatagtcagtttgctgaacaacaacggcgcttaaaagaagccgaaggtgagaaggatatcgccggtttgctacaatgggaaacagaacctaaaaagtagctcagaatgccccgaaccccacaagcaaaatcatttgggggcacaatagtgggcaccagtaaaaatccaacaagataaaaatcaataaattcaacagaccaagatatcaaattagactcctgtgattgcatgataccgtcgtgaatatggcggttttatccaggcgtaaagactgtgggtagtaatatcaagacgtgttgcgacgctggaaacagaatggccgcgctcaataacctgttttaccgctttaattataaactcttcgggataacgtttaccgctcatgggctcctctctttaagctatcttaaatgactctgcggtgtctgttaaacctgtggcgattcatttaattttttgtacgtatcccacataatcgtgctattcacatttagagatcacgtcatcgatctgctaacgaaggaatctctatgtgtaaatcccgtctcactgagcatcagaacatcgccgtaattaagttggccgaagccggatgaatggttaaagatatctgccctgaggcggatatttgtgaagtgactgactatatctatggacattgggtttcaccacatcctgtttctcactaatgtgctccgggaaagagttttcatcagatgagcgattgaaaagagaagccagaagctgaagttgcttcgaccaataagtctgtcacttgctcagactgtcacgatcagaattaagtcagaccaacttattggcaaggtataactcccggcattaagttacaaaattttctcatggcattagcattacacctccttaaagtttacatgcgtctctataaaagagtcttaaatttgtatataagaagttgatgagagcacaaatttcaccattaagtcattgaataacaatgcaataaaagaaaaaatcttaaattaggttttaataataagaattcattacaggttgacaggaattacttttatatttcatcacatcaccccgatagtgacgaaggcagcagacagatggtattgagaaccgttatttatcaccctcatgatttagcaaatagtgctgttttaagattttttatgatattggagatactgtataaaaatctcaatgagtgaaatacgaatccgaaatgatgtattacgactgtcggatctgtcatggttccttaaagctgtattttaggtctttccaggagtttatgacactgacaatatttcgcgacttttgacagtcgtagtactttatattatctggattgacacatttatttaccaatgaaatattaatagaaacatcgacaggagtcgttcaggatgatgagaaagccttcacaaattgtccattgcattagttgcgatttatcctgtcaattatttcctgacagcgcagtacgggtgcaatactgtcataatgcggcattttccatctggccagatggtaatgctttcctgaaaaaagggtttattgaaaagttattgcttgatagacacaatcatttatccagcggttttatctttgttgatttttctttcccgaatcttcgacgatttaccgatttgcaatgggctgacagtctggcagacagtggcatgcatattgtcctgatttctgacagaagtttaactccgctggccaattactggattttgaaaagcaataaaatacaagggattatttattccgatgacgatgatattgtgcaacagcaaaagatgcaccgcttgtttaccggtcggctcgccaacagtaaacgtggacgaacgcttaactatacggaatttatattactgaagcgctttgtatcaggaataagtattcagcagattgtaaatattgacaatattgatattaagaaactttatgtgcataagctgcggcttgaaaataagctagggcatagcattcataaaataatatcaaatattttatagatccgtttccatttttattatttccatattattgcgatgtggaagacgctttacgccataatgcaggaggcagaatgccaactccccaaaattactcattcatcgccatagcggtatcagcagcattagcctctatggtatttccctcccaggcggcctgggttgacgttgatagtctgccatccagtgggctggtcagtcagttgccgccggaattacaggctattattcccgctcaggccagtaccggtttcaccaaagtcgggaccatgcccaactacgtttatcagtggaacaccggcaccatcccggtttatggcaatggcctcacgcttaatgggccgggcgcggaggcgtttgaacacactgtcacggttattcaaaacagcgggacgggaagtccgggcgtgatttttggcaacgacctgaccattcggacgcagtcggcgaatgccgcgaataatggtagagacgtcgatggcatccgtactcacggcgcgaatactccggataacccggtatttattattaccggtgaccgtacccgcatctacgtggatggtcaggatggtgacggtattaacgccggatataactcactgggccagggttggaccggatcggccaatatttacgtcggcgacgatctgtatatcaaaacgaccggtagccagggacgtggcattacagccaacgccatgcgggatgcgtcacgtgccaaaaatacgattgtcgtcggcaatcgtgcgcatattgttactaccggcgacagttcggaggggctgcgtaccggacaaagcggttcgttgattcgtctgggtgacgatgcaactatcgaaacatccggcgcatcctcaacggggatttacgcagcatcctcctccagaaccgagcttggcaacaacgctactattacggtgaacggtgccagcgcacacgcggtatatgcaactaacgctaccgttaatttgggagagaatgccactattagcgttaacagcgccagtaaggctgcatcctatagtaaagcccctgccggtttatacgccctctcccgaggcgccattaatctggcaggcggtgcggctattactatggcgggcgataacagtagcgaaagttacgccatcagcacggagactggcggcattgttgacggttcttcaggaggtcgtttcgtcatcgacggtgatattcgtgctgctggcgccaccgctgccagcggtacgctaccgcagcagaacagtacgattaagctcaatatgacggacaactcgcgatgggacggggcgtcgtacatcaccagcgctacggcgggcacaggcgttatctctgtacaaatgagcgatgcgacctggaatatgaccagcagctcaacgctcactgacctgacgctgaatagtggcgcaaccattaacttcagccatgaagatggcgaaccatggcaaacgctcaccatcaatgaagattatgtaggcaacggcggtaagctggtctttaatactgtgctcaacgatgatgattccgaaacggacaggctgcaggttctcggcaatacttcaggcaacacatttgttgcagtaaataatattggaggagccggggcgcaaaccattgaaggtattgaaattgttaacgttgctggcaattccaacggtactttcgaaaaagcaagccgtattgttgccggagcctatgactacaacgtggtgcagaaaggtaaaaactggtatctgaccagctacattgagccggacgaaccgattattcctgatccagtagaccctgttatccctgaccctgtcgttcccgatccggtggaccctgatccagtagacccggttatccctgaccctgtgattcccgatccggtggaccctgatccagtagaccctgagccagtagacccggtcatccctgatccgacaattcctgacatagggcaatctgacacaccgccgataacagaacatcagttccgtccggaagtgggcagctatcttgccaacaactatgcggcaaatacgctgttcatgacgcgtctccatgaccgtctgggtgaaacccagtacaccgacatgctgacgggtgagaagaaggtcaccagcctgtggatgcgtaacgtcggcgcccatactcgcttcaacgatggcagcgggcagctaaaaacccgcatcaacagctatgtgttacaactgggaggcgatctggcacagtggagcactgacggtcttgaccgttggcatattggtgcaatggcaggttatgccaacagccagaaccgcacgctgtcgtccgtgagtgactatcattcccgtggtcaagtcaccggttacagcgtcggcctttacggcacctggtatgctaacaatatcgatcggtctggggcttatgtggatacctggatgctgtacaactggtttgataacaaggtcatgggtcaggatcaggccgctgagaaatataaatccaaaggaattaccgcctcggttgaagccggttacagcttcaggttaggtgaaagcgcgcatcaaagctactggttgcagcccaaagcgcaggtggtatggatgggcgtgcaggctgacgacaatcgcgaagccaatggtaccctcgtcaaggatgataccgccggtaatctgctaacccgcatgggcgtaaaagcctatattaacggccacaatgctattgataacgataaatctcgagagttccagccattcgtggaagcgaactggatccataatacgcagcctgccagcgtgaagatggacgatgtcagcagcgatatgcgtggtacgaagaatattggagaactgaaagtgggtattgaaggacaagttaccccgcgcctgaacgtatggggtaacgtggcgcaacaggtgggtgacacaggttatagtgatacccaaggaatgctggggatgaaatacagtttctgattcaggtaacaacagagccgctgatcttcagcggcttttacccggaaacgctttcatttggctgataggtttcatgaacggctcccaaaaaagcttaatgcgtacagaaaaatatcgggcgtttcccgatggtgaacataaagccacgatggccctgagtcaggatggtgtaactgatacttttccctggatagacataaaaatcgggtaaaaccgtctcgataaccgcatcggacagtgtttcgtcacgcgtgactttgttgatatccgtcgatataaaatgggtgctgtctttattttcactccatacataggaaacatcacggcggatcacgccgctcattttattatcgacgtaatatgttccgctgatggaaaccaccccagtgcgttttttcagcgaatacataaaatccagcgtcaggttagcctgagtgttgttataaaacacaatcacaggcgccgtacatttctctggatcccggttcttttccgtatacaaatgaaaaagatgtccaagccctacacccagacacagtagcgtcaggcaggctaacatcagtgcctttttacccatgtgtcaccccgcggaaaaaaagcgtcacgcagcctgtatcaccgcgcgttttataaggttgctgacaaatcaatgccgtaaccgctggggtgcgactgctggaagggaaatagacccatgggtatttctgacaatccataccggtttttagaatcattgacttatagcttgcaaagcggctgccgctttcgatatcttcattccgcgagaaaaaatgacagccctgagttgtttcaaccagcgtgtagcgatcgtaaaaatccttatcgggaacggtttgccagcttatagtgccaagcaaaataccgacagcaaatgtcccggtcatccaaagtacaggtacataatgtttaaaccaacgccctgacatacgcggtggcgtctcaccctttttttctattgcctgagcgaagtctttgcggatggtcatgaggctcacacctggctcaatctgaaagcctctacgcggaaccgtgattatcagcgtatcttcattttcgccaacggtacgtaatccgcggcgaataatggagatattctgataaagcgtatttgccgacaccaccatgccgtcttcttcccacactttttgaaagaatgtttgttgtgagacgacggagggggcgttttccagcagaaggcgcaagcagcggctggcgggcgttgtcagaataatgttgagatctggcctcgataatgaagccaggcgattcatttctggattaaattcaatattatcgttaattatccataacatcgcattgttaccatgccaaaacataacgtagttggagagggttaatagacaccactgagtatagtctgatgctgtggctgcgtagcaggacatggattgtcccctgcacataccgatcatatagaagagcgagaggcataagacattaacaggtaagcgtagacaccgcttttctcattatagcagactcaggggtgaaagtacgtttggttttcttgttcgttaagtctcctgttttgtattgaggtgagaatatcacctttaatcaagtggccaaatttactgtgccactacgctttaatatcttatatataaatcatgagaaaaaatatcctgataatctaccccacatgaaagacaaggttttattcaatgtgttcctataatggcttgtaatatcccaaaaagcagcactcgttatatagggatagtttccaatttattaagagttacagtagccatacttaataaaagcacgcttcccacttaatatttaagctgtgctttatgttatttaaatataaataagttaatccttaaccaacatatttcaaatttataccaaataattttaaaactatctatcagaaacaatttgtaggggcatagtttgttttttcaatcaataatcctctctgacatgtaaaatagaaacatttattcataatatgaatattgttgtgataacaaattcgcgtgaaagtaaatcgactgaaggtgatgccgatgaatattccttcagaaagaactcaacaggttaatccagaatcggcaacggattactgtcatcagcttaaaaacggaaatcgccccggcgattaatgactttaacactgatagtgactatcagtgaaaggcaacaacaaggaatgaattatgtctacacccgcgaattttaacggtcaacgccctgccattgatgctaacgacgcagtaatgctgctgattgatcaccaaagtggcctgtttcagaccgtcggcgacatgccgatgccggaattacgcgcgcgcgccgcggcgctggctaagatcgccaccttatgcaatatgccggtcattactaccgcatccgtaccacagggaccgaatggtccgctgattccggaaatccatgcgaatgcgccccacgcgcaatatgtcgcgcgtaaaggggaaattaatgcctgggataatgccgattttgtacaagcggtaaaagcgacaggccgtaaaacgctgatcatcgctggcactattaccagtgtctgtatggcttttccagccatcagcgccgtcgcggaagggtacaaggtatttgcggtaattgatgcctccggtacgtacagtaaaatggcacaggaaattacgatggcccgcgtggtgcaggcgggcgtagtaccaatggataccgcggcggtagcctctgagctgcaacgtacctggaatcgggaagatgccgcagaatgggcggatgtatataccaaaatattcccggcttatcagctactgattgaaagttataccaaagcgcaggaagtagtaaaaaataatgaactgctggattctcaacgcgcataaataacgccctgaagaggctaaatagccccatttaatggggctattttacttgccattttggacctgggcagtgctcgccaaaacgcgttagcgttttgaacgccgcttgcggcggcccgaagggcgagcgtagcgagtcaaacctcacgtactacgtgtacgctccggtttttgcgcgctgtccgtgtccaaactggctgcgccaataacgcctggtgggataggctcttaatcaaatacgccattaataatcgccgtgaccaccgcggtactgagcgcgatcagcaccagattatccccaacgattttccactcatagcccggataataaggtaattgtcccagcatagacgccggcaccgtttttttagcgattcccggcggtagcggttttcctctcgccagatttttcgcaatccccggaggtaaagactgataacccgtcagccctaaattcactgccagttgcctggcgacagcatagctaatgtccgactcgacgtgatccggtttaccgccatttttacggtgttccgttttttgcccggcatttcctttatgtccgttaccgttattaccctgattagccgcgttattaccatgtccgccgccattaccatttcccggattcgccagcacaggcgtagcgctcagggaaaacgtaatcaacgtcgccaggacggcggttaaaccacgacgattattcatgatattgcccttctgatgtgggataccatgaaaatagcgccccgccataaaaagaacaactacatcgattcttattttaagcggggctcgccaacagcagcttatcgtatccagatagtcagtaaaatcaggatgattgctatcaggacaacctgataaaaaattttgtccaaccctcttttttgcatggcgtcacctcgttagaaaacgatttgccagagggctaaacacaacaccaacaggctaatcagtaaaaatatcagcgcgatgattttatcgggtgagcgattcatctgggcgatcctcaaacattattaaaaccactggccaaagcgtttgatataaaagcgcttcatgccttgcgccaccagacagtagctcaataatgtcgccaccaaccacgggaagtagctcagcggcagcggctccagtccaaccatcgcgcccagaggtgagaatggaatataaatgcctatcgccataatcaagccggtcgtcaataataccggcaacgtcgcccgactttggataaacggtattttctgcgtccttagcatatgcacaaccagtgtctgcgagagcagaccctcaataaaccagccggactgaaagagcgcctgcgcctctacgttattagccgcaaagacgtaccacatcagcgcaaaggttgtgatatcgaaaatagaagacgttgggccaatccatagcataaaacgaccaatatttttcgcgtcccatttccgcggcttacgcaggaactctttatccattttgtcccacggcaacgacaactgcgaaatgtcgtacatcaaattctggatcaacagatgaatcgccagcatcggcagaaacggaataaacgcgctggctaccagtaccgaaaaaacattgccgaaattagagctggcggtcatattcagatatttaatgatattgccaaaggtttcccgccctttgataacgccttcctcaagcaccatgagatctttttccagcagaataatatctgatgactctttagcaatatcggcggcgctatcgacggaaatccccacatccgcatcacgaagcgcgggcgcgtcgttgatcccatccccaagaaaaccaacggtatgaccatttttctgtagcgcttgcaaaatacgcgttttttgtaacggcgtcagccgggcgaatactgcgcgtttctccacctcagacgccagttcggcatctgacatcgcctcaacctgggttccggtcaggatatcgtgcgtatcaatacccacttccagacagatacgcgccgtcacaaccggattatcgccggtgaggactttgaccgccacgccgttatcccgcaacgcggcaatagcttttccggcgctttctttcggcggatcgagaaaagtgagcatcccttcgatggtaagttcggtctcatcctccacacttaatgtcggattgttcccggaaccatccagcttacgtgtcgctatcagcaatacacggaatccctgcgcattgtaatcttcggttttcgccagcagtagctcgcggcgtgtttccgtcagcgccaccacacgatcgccttcgcgaagatgggtggctaccatcatcatctcttcaacggcgcctttgcagatcaggcatctgtctccatgctgcgcatcctccaccaggaccgatacccggcgacgtacaaagtcgaatggcagttcatcgcgtttaatgaagcgcgcttttgtcgatggtgcgattcgaccctcgccaaaacgcagtatggcgcgatccatcacattccgggcgccgctctggctgctactattcagccaggccagcatcaatacccggctgctttttacaccgctcacatccagatgatgctccagaaaaatattgtcctgggttaaggtgccggttttatctgtacacagcacatccatcgcgccgaagttttgaatagcgttcaggcgcttgacgatcactttgcgccgcgacatcgcaatcgcgccttttgccaggttggaactgacaatcatgggcaacatttccggcgtcaaccccaccgcaactgccagcgcgaacagcgaagcctctacccagtctcccttactgaacccattgatcagcaggacaaccggcaccatgatcagcataaagcgtatcaacagccagctcacgctgttgactccgcgatcgaaagccgtctgggtacgcgtacccacaatggatttcgccagcgagccgaaccaggtacggcttcccgtcgcaaccacgaccgcttgcgctctgccgctggttacattggttcccatcagacagatattgcccaaatctagcaggcttttatctttatcaggcaattgctcgctgtctttacctgccacatcagccataacatcgtatttttctacgggtaatgattcaccactaagaattgactgactgataaagagatcgcgcgacgccagcagtcgaacgtcggcgggcaccagatcgcctgcggccagaaaaaccacatcgcccggcaccagttcttcaatgggaatctcttcctgcaccgcgcctatattgcccggcccacgacgcaacaccgtggcggtggtgcgaaccatctttttcagcgcctgtgctgctctgttagtgcgaaactcctgccagaaacgcaataacccgctcaaactgaccatcgtcagaataatcagcacaccagtgagatcggtctcttcgccacggcgtaacgggagccagtaatccgtgatgaaactaacccctgccaatgccatcagaacgtaaataaacgggttattgaatgcctgcagaagctgaatcagcgccggaggaacttgctcatgcgccacttcattgcgcccatacactttcaaccgttcgctggcctcttctatcgtgaggccctgacgatggctgttcagccgcgccagtgtctcctccgggctatgaaaagcttccgcttcgatcggaaatacttttttatgctgcttatcattttctgacgccgggcgattgagtttccggttttcaatgttcatgtcagtcatgatgaatccccaaaattaaggtgtagtgtttcctgcatatcacgcccggggaatagtaaactcacgattagaaggtgaatgccccgggagaattatctatgcataaaaaaggttattgcttactcactattttgagtgggttttattttatcgactcgggaatatccatcattccctccttatacgcctggcgtaatgttgcaattgaataaaaaactattattgactatcaatgctccagtgaattgcggtgatattatcgttatcacctattctggatataatcagctctcgcgttttacgataatcagcatgacccacgagctcggcacgaatttctttatagccctgttcctgagcggggaccgaacctaacccttgtaaacagatcgcggcctcttttacgatattcagtaaccactgacgaaccgcgctctcatcttctttattacaggttactttcaggatataacgtttttctccctcagcggatattgggagttgatttatacgctgcgccgcttcacgcaataaaatattggcgcaaagaataatgatcgtcgccgccagcgcatttttgaactgccctaagccgcataacacgccgatgcccgccgaacaccatagcgttgccgcagtgttcagcccgcgcacattcatcccttcgcgcatgatgacgcccgcccccagaaagccaatcccagagacaatctgcgccgcaattcgcccggggctgtctggcgatgtcgtcatggagctcagaataaaaacggcggcgcctgtcgccaccagcgcattagtgcgtaatcccgccatacgttgacgccattgtctttccgcgccaatcagcgcgcccaacagcatagcggccagtaaatttaaaatataaggaaacattaacatacgttcctccattttttctggaagaataagtacgtgctatatttagcacacgacaaatttctgccctgaggcaattagcgtcgtgttaacggcggaggaaataaagcgtgtttaaacatgaacatgacgattacctcgcgacaatgcgcgtgttgtaacattattgggatgacaatcgtcacaaggggagattgctgcccaccggttcggcaagcagcgcaggaatagcgtgcgttaacttgccagatgatttacgtaaaagtgactgtccaacatattactcctgcatgaatttgcgcttattatagtcagccaatatgttccgtaaagtgcaaaggcgggtttagtgacgttctgtttaagtttgtttgatattttttcttatgacaaaaaaatgacaatattatgtcgataacaagctcgtctgaaatcattaaacaataaattcctgcttaataccggcgatagctctgttatgatgcctgcacgtaaaaaaataaaacaacatgacgaggaaaaaatgggttccaccagaaaagggatgctaaacgtcctgattgccgccgtattgtgggggagttcaggcgtttgcgcgcagtacatcatggagcaaagccgtatgtcgtcacagttcctgacgatgatacgtttgttattcgccgggctgatactggtgaccttctcctttatgcacggcgataagatattttcaattcttaaaaaccgcaaagatgccctgagtctgctgattttctccgtggtgggcgcgctcaccgttcagctaaccttcctgctcacgattgaaaaatccaatgccgccaccgcgacagtgctgcaatttttatcgccgaccattattgtagcgtggtttgcattagcgcgaagaacacgaccaggcattctggtcttaaccgccattcttacatcgcttatcggcacctttttactggtgactcacggcaatccaacatcgctgtcgatctcttcagccgcgctgttctggggtatcgcctccgcatttgccgccgccttttatacgacctggccttccaggctaatcgcccaatacggcacactgccagtggtcggctggagtatgtcctttggcggccttattctgctgcccttctacgctaaagaaggaacgcactttgcggtgagcggcagcctgattctggcctttttctacctggtggtgatcggtacatcgctgacgttcagcctgtatttgaaaggcgcgcaactgattggtggccccaaagccagcattttaagctgcgcggaaccgttaagcagcgccctgctgtcgctactgctgttggggattagttttaccttgccggactggctgggcacgctgctcattctctcgtcagtgattctgatctccctcgattcccgtcgacgcgcgcgggccgcttaacgccgttgataatcacgatgaccgggcggaagagggaaaagtttaatggcgctttgccttaatctcttcgtcagaaagcccggtaatcatcagcaccatctctcgctcgatcccctgttccagcatcgtatgcgcaatacgcaaggcttcctcctgcttaccttgatgtataccttgctgtatgccttgttgcacgccttcacgcttaccttttctgcgccccgattcacgtattctgtctacgatcgtcattaatctctccttgtgttggggaacacggcgcgccacctcgcggataaacttgccaaaacgaggcgtgctgccatgctgtattagcaaataattaaacagcgcttttagctgactgtcattagcgtttcccgtaatcagaagtaccgctaagcgctcgaccaatcccatcaggtcgcgttgacgtatatgcttttgtaccagttccagcatcgcgatacgtcgatgctgcataatctcgttatccggcaccaccgtaatgtctaccagtggaaatgccgtcgcataaagctgacgcgccagcgcaggatcgtcaaactcatccagccagcaaagcgaaaagggatacgggcttttcgcgccatggtaaaacagcatgggaatcaccagcggtaacgttttatggccagcatccagatggcgctgcatcgcggcagtggcgtaacgcattaaccggaacgccatatgcgcgtccggcgtactctgatgctctataacgacatagatataaccgtcgccttcacacgtttttagcgaccaaaggacatcggaataaaacgcgcgtaaatttttctcgataaaactgtccggcgccagtttcaacgtcgtcagatcgcaacgtattcttagcgaatggggaagatgaatattgagaaaatcccgcgcggtatccggatggcgtaaaaacgttttgaataccgcatcatgaggcgtggacgtggggctttttttcatggcgatccgtcacctgaggaataagatgacgccactgtactcgccaaaaatacagacagcattcaggaaaatttacccctgcgaggaggctcgaaagggaatcactgacggctgcaatacgtacatttttgcccagcctgctacgcattatcgcccgatagcgtaacgctaaccgggcctacaaatacacgtcatctgtaggccaggtaaacgcagcgctcttcggcgataaatctcacaccagcgctttgactatctccatcaaccgaatgatgtcttcggggcgcgtattgccggtttgcggatcgataatcgagctgtaaacatgcggcatgacgcgcggcacgcctgcttccaggcaggtttgcaggataataccgaaattatccagtgagataccgccggtcggctcgataagcgtcatgccgtggcgggcagcggttgtcgccagcgcatataattccggtaacgacttttcgccgcccatcgggaaaaacttcgccgcatgtgcgcccatatcctgcatcatgcgtaccgccgcttcacaggaaacgcgggctggcgttccctggctgctgctgacgccggtagaaatcaccacctcgccaggcgttcccgtcgggctgaccagggcgttgatatgcgtttgctcgccgcccgtcgccgccagcgcgcccgccgcgaagccgctgccggtaaaggtctggttgacatgggccgggtgagtatgggcggcaatcatcgccgctttgtagtactgcgccgggtcgcctgcgcccagacccactgagatagacggcacctccgccatccagcgtttcacctccggcacgccctcttctaccgtagcgaactgcgcggaaagtacgccaatgaccgcatggccttcggcggcttcatagatagccttcgcgttggcgatatcctttgccagcacgttaatcgctacccgctgacgataaaaattaatctgctgcatgttctgcaatctccctgagtcgcgccacaatcaatgccatttccccttcggctaccgtgcgtggatcgaggctaaaaaccccctgatgaagctgatatttgcgggcgtaaatcgctatctcgccgccgcgcagctgcgcttcgacgtcctgcgcgttcagccccaattcagatgcgttcacccgcacacgaatacgccagattgcacgcccggcctcatcctgttcgatatcggcataaagtccatggatggcggaaatcgcttccgcgaccggctgtaactgtgctgcggtcacggtcgtctggccctggtggtaattctccagcgcatacaccagcccaaccatgttttccttgccgattttcattgctctggcaatcccctggtgctgcgctttgcaggcggcaatccacgttttcctaccagtgataaagccggaggttggcgcattaaaggctttcgcgccgctatagataaccatatccgcgccgctcgccacccagccgcgcaaatcctcttccgccgcggcatcgacaatcaacggcaggtggttggcctgcgccacctgtacaaaatcgtcaatgctcaacatgcctttctgtacgcaatggtgtgatttcacatacagtagcgcggcggtcttttcgttaatggcgctttccagttgccagcgggtcgccagattgctcgaccccacttccactatgcgcccgccgccaagacgaatggcgctggtgactggcgcgccgtagtccacattatgcccgcgcagcatcactacctcattggccataccgctactgtccggcatcagggcgacgcgcgcccgatcgccgtgggtgatagcggcagcgacggcaatggcaatacccgccgaggcgcacgaggtgatatagctatcttcagcacccgtatagcgcgataccagttcgccggttttttccaccagcgcgtcaatctcgacgaaagcggaagccgcgcgcgcggtggcctgcatgacctccggcgcgacgcttgagacgcccagaatggtcattttgccgcaggcgttaatgacctttttcaaccccagttgttgatagatattcggcgtcatgatttacagcactcccaacaacgaacagactatgctcagtgcgacaatcgacagcaaaatggtggtgtagcgcggccctttttttaccagatagaagtagatggcgaataccgccgccagtggcagtaagcccggcgcgatagagtcgaggatctgctgaaccaccacttcagatcctttcaaggcgctaatttttaacggcgtggtgattttgacgtagctggcggaaagcgcgcccatcatgatcaaacccagcacgttggccccgtagatcagttctttgattcgccccccttgcagcaggccgataatcgaatcacgccccagcgtatatcccttgtggaccataccgtagctgatcgccagggtgatcgccgggtagagaatcagcgggataataccgcccatcgcgctgccatttgccgcgaacggaataaagatcgctatcaacagcggcatcaccgccgcccagataatcgagtcgcccatcccggcaagcggccccatcaggcccgttttaatgccggtgatagacgagtcgttaatcggctcgccgcgcgttttttgttcttccatggcaatagagatgccctgaatcaccgcgccgaaggtctgctcggagttaaagaagttaaggtggcgttttagcgcttctacctgctcctctttttgtgggtaaagttttttgatgatcggcgtcatcgaggcgcagaaaatcaggctttgtaagcgctcataggagctggaaacctcggcgcccagccagtagataaaccaggctttggtgatatctgctttggtcagcgccccgctttcccgcgcgcgctcaaccagttcatgttgcattacgtcactgctcatcatgctgctccttcatttttcgccaggcctttaatcaggaaggcgacacaggtgccgaagatggccatcgccatgatgtcgaccttgaggtacaacaccgcgaagaacccgccgataaaccacggcaacaggctctttttaccgatcaccataatggtgatggcaaagcccagcgccggcagaatgccgcccatgatttcaaaggagtgggttaaccagtgcggcatcagtttaaggaaactttccaccacatcctggccaaagtagttagcggcaaaaaccaccgggaagcgcagcaccagccccagcaatgccgggtaaagaaaggcgcaacgcatgatgcccgccatgtttgccgtttccgcgtgtttatccgccatatgcacccaggcagcattcagcgtgcgcctaagctgatcgagaaacacgccaatcacgccaaacgggattgccagcgcgatcgccaggtttgggtccataccggccttcaccgcgataggaatggagatacaggccgccagcgccgggtccgacggcacgttgccgcccggcgttgaggtcacgcccaaataaacgagctgcatccctgcgccgatgatcatcgcagtctgcatattgccaagcaaaagcccgacaaataccgcgatcaccaccggttgtaacagcatcgcggagaaggtgtagccgaggcgtaaacgggcaaaccagtaatacaaccccatcaggcttgcaaagagtaaggtatccatagtgttatcctatacacttcatccttcaggctgcctctttgttggctgccttcgctcaccccagtcacttactttagtaagctccaggggattcactcagttgccgccttgatgcatccagaatgattttgtgtctattaaagggttagaattttttcaggatatcgtcgagcggctgcggcttatcttccggaatggtctggaaaaatacctgaacgccacggtttttcaggtcgttaagaatgccgacgtctttttcatccagcgtaatattctgaaaaaccgccttgcggtttggcccgccgccgagaccgccaacctgaatgcgggtgacgtcaaagcccagttgtatggcgtcctgcaccgccgccagtgacggaaaaagcaccagcacgttaccgtcgccaagctgattttctttccatgcagcggcaaaactctggttgccgaagcaatccactttgatatttggcggcgccgccatcaggtagatatttttcataaacggatcggcgtccagttcatcactcacaacggctatccggttcgcctgagattgtccgacccacttcgtgacaacctgtccatgaatgagacggctgtcgatgcggcataaaacgatattggccatgatgttttccttagagtgattgttgtagctgacgtacatgggcgaccacatccaggcagctactgcgcccggcctcaactaactcgtccacgcaggcggttagcatcccttgttcgcgcctgtccagcgcctccagcagtagcgacgcattcagtccggcaatcaccgccaccggataatcggcgcttagccgcgccgcgacgttggacgttgtgccgccgacaaaatccgtcaggatcagcgagccttccggcagcgttttcaccacggcctcgacgcgttgataaaactcgcccagcgtatcgacaggcattagcgcgatttccgtcacgcctttaatttcgcccgtgaccatacgcaggctgttgcaaagcggttgtccccagccgccatgcgtcagcagcaggatgtggggcaacggttgtgtggtagtcaaaatggcctcctggcgcaattacatgaggacaccggcatatattgcccggtggcactgcgcttaccgggcctacaggacactcccggtaggccggataaggcgtttacgccgctatccggcataacgcatcatcagaagagcaaaggttgtgccagaatttgtgtcacgcgaggaagaagaaaggtctggcgaggcgcgaagccccgccagtaaaaggattaactatagagcagttcgtagatataaaaatattccgcatccgataaacggatggcgtaggcgtcttcgatcggcagaaaagcggatttgatgacactaaacgcgcgcgcgtccagattcggctgactttccaacgccatctgtaacggttttcggttaatcacaatacgctctaccatacagcagcagtggatcaggaagcgcagtgtcacctggcggcttggtttcagggaaagcgaagacgtcagatggttaaaaacgccctccatctctttcagaatacgctgcgggttaagcacggaaatatggttgatgatactctccatcgttagcgcgctgataaagcgcatggcgctgcgctccatctccagacggcgttcagcgttggacagatcgggcgttaacaggctcaacaccagttccggcccttgttcggagaaaagctcttccagcgaaataaacggaatatccggcagccccggctggaaagtgccgacaatccccgccagccgctcgctggcattcaatgcctgctgaacgcgctccagacttcgtacctcgttataatcaaggatcaccatcctggtgtcctgcgacatcagttcgccaaagctctcctccagcacctttttgattttttccgccgttcccatgccagtaatacaggagatgaccagcactttgccgccgttctcctgctgcggcgtacaaagctggcaggggatatttttactctgcaggagcgccgtcaactgtggtaagtcgctggtttcatagcttaaatccagcccgacttccagcagactggtcagcgtgatgttcggcatgagcaaaacatctatctggaataacttactgatcgtactgccgaaatggatcaatgagccgatgtccaccaacaggataagccgccgatattggcgggtttgaatcatttgggtcagcgtttccagcgtgtcatgcaccgactgttcaaacggcatgtcgatggcgctgaacagctcgcgctccagcacgcggttgacatattgcgcctgactggtggcggtggtcgcgccgtgggcgattaaaataaccccgcagtcggggctggcatcgatacgctgacgataatggcggcactctttcaggaacaggcatagccagaccacttccgtcgccggacactgaatatgcagcagttcgttgattttccgacacagcagcgtggcgttgtcatattcgtctttgcagcgatccaggatcaaactggaagagtaaagctgcgggatcaggccgcgctgcacgtagcctatcagcgccaggaagtgtttacgcagtgggttaaccagattttccggcagcgaaaagcccaacacctgctctacgcagccaatcagcagcgtcacgcgctcttcaatctggtcgccatagcgcggcggatgcgccacgctgtcacggctgtagagaccgtattcaaaaatcgagctgagtttatttttcaggatcgccagcgtctccgccggggggacgttactgttgcgcaaattaacatactcgcgcgtcaggaagctgtaaaagaggtcgctctcttcaatttccgccccggtcgccagcgacgtcttcaatgcgggcagcgtgcgcgcgtctatatttagccgcgctttaccctcaaacagagtatccaccaatagacgctgttccggcgtcgggttaaccgacatttccgccagccgcttatccagctgtagcgtgtcgttatgctcggtcattcccgatgcccacgcctgagcgcagagaaactgaatatcgcttttaagctgaccgatattgccttccaggggtttattcagcaaccagagtaacaacggtttatcaatgctgaccgtgcgttctattttgcggctttcccgctgtaagaaccccacgatcagttcgatctgttcttcaacggagcgctggcgaatgcccggcaaatcaatgcatacctgaatacgccgctggaaagtacgtaacagcgccgacccgaccggctcggtagtggcgcaaatcaggcgtaccgaaattgatcgcggctggctgctcacgccgagcggacggtactcgcctttatccagaatagagaacagcttttcctgcccttcataagacagacggtgcacctcgtccaacagcagataaccaccgtccgcctgctccacgaggcctgttttatgttcattcgcgccggtaaacgccccctgccgatgaccaaacagatgcgaggagagcagttccgggttatgggcgtattccgcgcagttaaagtagaccagcggcgggatagcgccgctcgcctgttcacaggcgaaacggtgcatcagttccgcaaaaaaggttttaccgacgccggacggcccggtaagcagaacgtgtaaaccgtgcggatagagcaccgccgcacggcctttttctaccgcatcgcgcaggctgcgatcgtaaccaatcaggctggtaaacggatcgtcgggcgcgtaatgctcttcatgcggcagcacatccgccaccgaccgcacctcgcgttcagactcttccagctgtcgtcccagcaacgtttccagcgcctggcgatgcagaaaatagaccgggcggccacggcttttgattgccaggccgtcattccataactgattgagatctttgctgacggagttacgcgccagcccaagattgaaacctatcgcctccgccgtaaacgccgtctcctgcgccaaatcggcaagacatagcccgcgcgtcagccgttccagctctcccagtacgatctcaatacgtctcattacactaccgcttacgaaataaaagagtagtcagaacatacactattctgccacgcaagaaagtgaaggcgcagcgagaaaccgccttcccacttttgcctgacttcaacgccaacggatagcacgccccgatgagtgaacgtcgcacggtctacacttactcttgaaaaagtgcaaaccgataaggataccgtttatgaaacgaaaaacgcttctgcttattgccacacttgtcgcgctaccgggcgtcacgtatgccgactctccgtttagctcactccagtcggcgcatgaaaaaaatacgattttaaaggatttgcgcaaaatgtgtacgcccaaaggcgcgctaaccgatgaagcctgggagaaaaaaatcatggcgagcgaggggaaccagcagcatattcgggaggcgatgatcgcgatagagcgcaacaatcagcataactactggcaggctctcggcaaggtggaatgcccggagatgtagcacagcttttccgctttttggtcgcgaaaatgcggactgtaaccggtttctgttcgctaaaagcgcgtattctggagcgaatttacgcgatcaaggagtacgacaatgcgataccgttttcccgataacttctggtggggcagcgcctgctcagcgttgcaaaccgaaggggatagtctgaatggcggtaaaagccagaccacgtgggatgtgtggttcgagcgccagccgggtcgttttcaccagggcgtcggtccagcggaaacctcaacgttctatcgccactggaagcaagacatcgcgctactgaaacagttaaaacataacagttttcgcacctcgctaagctgggcgcggctcattccagacggcgtaggcgaggtgaatccacaagcggtgagcttctacaatcacgtcatcgacgagctactggcgcagggcatcacgccgtttattacgctgttccattttgatatgccgatggtcatgcaggagaaaggcggctgggaaaatcgcgacgtcgtagaggcgtttggtcggtacgcgcaaacgtgttttaccttgtttggcgaccgcgtgaagcactggtttacctttaacgagccgattgtgccggtggaaggcggctatttgtacgacttccactatcccaatgtggtggattttaaacgggcggccaccgtggcgtaccataccgtgctggcgcactcgaccgccgtgcgcgcctggcgcgccgggcgctacgacggtgaaatcggcatagtactgaatctgacgccgtcctacccacgctcgcagcatcccgccgatgtgcaagccgcgcaccatgcggatctgttattcaaccgcagttttcttgacccggtattaaagggagaatacccggcggacttggtggcgctgctgaaaacctatgaccagttgcctgcctgtcagccaggcgaccgtcagcttattgccgacggcaaaatcgatttactggggattaactattatcagccgcgccgcgtgaaatgccgtgatacggcggtgaatccgcaagcgccgtttatgccggagtggttatttgactattacgacatgccggggcgcaagatgaacccttaccgcggctgggaaatttacgcgccaggaatttacgacatcatcaccaacctgcgggataattacggcaatccgcgctgttttatctccgaaaacgggatgggcgttgagaacgagcagcgttttgtgcaagcgggacagattcacgatgattaccggattgactttatttctgagcatcttaaatggctgcataaaggcattagcgagggctgtcactgtcttggctaccacatgtggacctttatcgataactggtcatggctgaacggctataaaaatcgctatggttttgtacaactggatttagccacccaaacgcgcacggtgaaaaaaagcggagaatggtttgccgccaccgcagagcataacggttttgattaagcatttattattgccggatgacgactaacgtcgtatccggcctacaaatggcagcaatatcaactcattggcgtaatacggactttcgccgccacgactaacgccgtcaacagcatcaggccgccggaaagcgccagcggcgaaagcagcccgaaattgtcgagcgcataaccgcccaccgccgcgccacaggtatttgccagttgaatcaccgcgacctggatggaaccggctttttccgcctgatcggcaagagaacgagtgatccacgttgaccatcccaccggcaccagcgcaaacgccagcccccagataatcgctattgccgccgccacggttttgtcgcttccccacacaatgagcgtcagcgcgctcagcgccagtagcagcggcgcaccggccagcgccagttttaccgaacgtttcaggacataggatgagaaagaagtgccaacgaagctggcaataccaaaacttagcaacaccagcgtcagaccatcaacgtcaaagcccgccagattcatatagaccgggcgaatataggtaaagaaagcgaactgcccggcaaaagacataaagatggcgatcatcccggccatcacgccagggcgttgcaacaggctaaacatattctgtttctggtgagaaggttcgcccggcagcgacggcagtgatttcaccacccagatgacgcacagtacgcccatcaccgcagcggcgttaaagacattacgccagccaataataccgcccaaaaagctgcccagcggcgcggcgatcactaacgcgatggagacagcgccaaaaatcaccgacagcgctttcggcacggtacgcgcgggaaccagtcgcatggtcagcgacgccgacatcgcccagaatccgcccagcgccaacccaagacaggcgcggcccagcaatagcagcgtaaagctgttggcaaaggagaccatcagacaagaagccgtcagcaaaacggcgaacagaataacgatataacgcctgtcggtcgcctgaataatctgggtaatgaacaggctggaaaacatcgcgacaaacgccgtaacggtgaccgactgaccggcgacgccctcggagatccccagatcctgcgccatcggcgtcaacagactaacgggcaaaaactcaacggtaatcaggcaggcgacacaaaacgccacggcaaaaacggctgaccagttaggcctggcaaccccatcagcgcggaatttttctgcgatattttcattcattgtggttacctgcgtcgttttagtgcggaaaatccacgcagtgtaacattacaaaatgtgatctgattaacgttttagcaactgacattgttgcgctgcattttgcgaggctggtcgagagttgagaattatcttctctcgctgcgtgtaaaaccaaaaggtaagacatagtgtatcacctggtgctatactttagattacaggatgtcaacctgatgcgaaccttcaaaaccaggtggtttaacagagaagcgaagccccacacgataaaagatgacgagttaagcgaggccatcaacgccgtactgcaaggaaaagcagataatcttggcggcggggtttataaaaaacgtctcaatcaaaatcgcgatcgcgcaatcgtgttggcaaagggaggcgaacattggttttacaccttcctgtatgccaaacaggatatggccaacattagctatcgcgaactcgcgggtttccgtgagttagcaaaacactatgcttgcctgaccgaagatcagataacggcactcattaataacaaagaactggtagaggtgcgccatgtcagcaaaaactaaattcaaaagccctgcctttgaaccgattcatagcgcggcatctggattatttagcgtggatgccattccccaggagacaatgcgcagttttgacacggcctgcttaagcagcatcaaagacctgcagccacttgaaataaaagcgttacgagaaaaactcaacgttagccagccggttttcgctcggtacctgaataccagcgtatcaacggttcaaaagtgggaaagcggcgccaagcgtcccagcgggatgtcactgaaactacttaatgttgtccaaaaacacgggctaaaggtgctggtatgagggttttaccgatggtctgttaaggctattcatacgatcatgagtgcaggaagcctctacaacttcctgcgctgtttgacgggaattgcactatactgactcaccaaagccatcagcaaatgcagattttaattcatccataaaagccagttcatcctgtccatcacaaattaaatcaatcattgtgtttccctttacgccagcccccaaaatactcatcattcctttaatgggaatttctttgtcattattaactagcgttaatgaagactggtattttttgacaattttcgcaagcgtagcggctggccgcgcatgaagccccgtactgttcataacgcgtactttttgtctaatcatatattttccttaagagactttgcggaatgctgagtgatttttattcatcatcttaattttagaataaacatcatcctcaactgcctgttttgcgttcgccatgacacgcgccagattagcctcgttgttattatttacccaagccttaccaacagtagtaataaaggctttgcgcaaatcactcgcaatattcactttggctactttgtaattaacaaagctgcgaagaatatccgcgtcaataccagaacctccatgaataaccaaaggtaccggactgacagacgcgatgcgttgtaatagcgggatatcaatgcgtgggatatcttcaagaccatgtacattaccaattgacactgccagcatgtcgcaccctgtctcctcaacaaagcgctgaaccttctcaggttcagttttgcagtcagcctcgctgacatgatcatcttccttacccagaatagcgcctaattccgcttcgacgggaacaccaaatgatttacagaaatcgacagcttctcgggtaaatgcaatattttcttcgagcggtagcgccgcgccatcaatcattactgaggtaaatccggcccggacagcctgcttaacatcttccagagttttcccatgatccagatgcaggctgacaggaatatccattttatcggcatgtcgcttaactatttcataaatgtaatcgtaacctgaaagctgtgcattagtaggagcaatttgaataaaattgggcaatccggaacgttctattgcattaagaatggaaattgttgtctccaggttcgttgtattaaatgcccccgcaaggacatgtttttcctgaatacaattgagcaggatcctaccattgactaaaggcatattaactccagatatttatgtgagcagtgtaagtaaattatcgaactattgagttatcacagttattcaccaataagcgccccttcttgccgcagtttaaattggtaaaatgacagccattgctgctgatatattttcaactttgcagaacgaaccgcgtcaggaaaatatcgctcagccacaggaacagtcggggggacaacattcggacaggctatcaacaatgctccaagggagacggtttcatcaaaagcaatggcctcaattggacactggaggatgtcagccttcaactggagccagtatgggtttttcaccgcagggccaatgacttttactgtcctgcccgccgggatattaaagcacccgtgacagtgtgcaaactccatcgccaggccaataaagacactctcaagcagagactccggaggaagtgaatccgtcagaccaaaaagcaggccacgagtgtgccgatttttatttggcgaacccgagccccgcaaatgaggaataaataccggcacatgctcgacagaccaggaaggtttgaggtactgctccatgactttttccaggcctgtgcttatttccttatcagttaaacgaaaggtttttttcacccattcaagcgcataaccgccgacaggcagagaagcgaaaagcgtgaaaaattcaccatcggagtaacaaccatttgccagcttattcctgcgagcctgcacatcaagcgttggctgtgtattcagcagtaaaataccctctgtcgtgccggtagaattcagcacatcgcccggttgcatctgtaatgcgcgggcaccgaccatatgatcgtgtccagcgagggtgacttttacctcatgagagaagcccaattcctctctaagcgttgccgtcatccatccggccacttcacctggctttatcaacggagccagtacaccgaacggtatgccgagaatcccggcagcattacgagaccaggtacggcgagcaatgtccagacacaacgttctactggccagggatatttccgtctttttcgcacctgtcattctccacaacaacacttctggtgcatgtaaccagcagatatcttttctttcatgcaaggaatagttatcaagcaaccatctcattttaaatgctgagtaattactgtgaggtggcaatcccgttatagaatacagttcttcagcctctgccttgcttaatgacgagagataagattcaccacgtcgatcataccaggccagcatcggggtaagaatgacgccctccttatccacaaagacgccagactcaccgaaactcgcaatactgatattttttaccggaaacggtactgaagccaccagttcagccattaccagtcgcagtgcctgccacagcgcttcgatatcgaaatctacctcgcctttgtccgacgatattgttggcgtcggaaacttgcggacttccagaactgacacgtcatgacaggaataacagctgactttgcagttagttgtgccaatgtcaatgacaagcgctgcgtggtaatcaggcatagaccgttccttttgtcaggcgaaaaacaccataaataatcagcgcaagcacaggaatcagcccgatagcaataatatttccgttgaatatttcaagcagccagaaacggaaggggttaccgccatcaaggaagcttgatacctgaccacttgacccctcagccattttgaaattgacatctttagccataccggtaataaatggcgcaattttggtcgcaatccacaagtcggcgacaataacaggaattgcggttatcacagcccggaaaatattgccacgacatgccagtacaatcatggaagccatgactgccaggttcgcaaggtctccgagtggcaggactttattgccaggaagaaggaatgcaataaagacagagataggtgtcagaatcagtgctgtagatataatggctgggttacctactgctaccgcgatatccagtccgataaagagatcatcacggccaggatatttggcattcaaatatttcttaatggcttcagacagaggtaataaaccttccatcaaaattcgtaccatacgcggaagaatgaacatgacaccgccaatgctgatccccagcaacaggatatgtttaaagtcatatccggcaatgatgcccaacaagacccccagaatagtacccaccatcataggctcgccgaagattcccatttttttctgaacgttttccggatcaatatgaatacggttaacgcctgggatcttgtcgataattttatcgaacagcaatccaatcggaaagaagacgacagatgacagggtcggaagtgaaataccttccagaccgaagtactttgccactaatggcgctgaccagtccgccagtttgagaaccacgatcgcggcaatagcggctgcggacaaacccaaaacaaaactccctgtgctgtagtaaaccagcgttccagccagggcaaagtgccagtagttccacatgtcgacatcaacagtacgtgtcttattcagggccagcatggcgacattaatcagcatcgtcagcggaatgacaaagggtgcgattggtgagccccaggtaattgcggccaatggtggccagcctaaatcgacaacaggaaggctaataccagttcgctcaaccattgcctgtgcagccgggcctacgttgctggtaagtatgtcaaagatggcataaattccgacaaaccctattccgacaattaacgatgagcgaagtgctttagcgggttttactttgaagaacaatgccaggaaaaaaaggaccagcggcaataaaaccgttgggccaaaccccaggacatattgcacaacggtatagagagtatgtgctatatcattcatatccgacctcttattcagatgtgaccagacctcgcgttagcgcctggataatttatctgttttttatttatgaaatcaggcttggcctttaaggattgaaactattttttcaagaactttatcttcacctactccggtaatgattggcaggccactaacaaccggaatatccagttcataaggaactttcgttgttgatacaaccaaagctgcaccatcggtattgtttggcaatgaggctacattagtttgtgaataattaacatcaagcccattatctttacaatattccattactttttctgccacagccgtggaagtagcaacacccgttgcgcaaacaaatagtatcattttactcatacttcacctctttcagatatgcgtgtgtaaattgactgataaatttcatcatcattcatgaccagtaactgctgcataaaatcctcatcctggatcacatccataatccaacccagtacgttgagctgcttattgctttcacctaaagcaagcataaacaccaccctgacaggtacgggatctggttccccgcccatatcttcgaaattgacgggttctgccagtattccaacactaatggcgttttggcgaacatacttgtgatcagtatgtggaatagcgacgcctacaggctcaaccggtagacccgttggaaaattctgttctcgcgtaatgacgtgatcggcaaaatcagatacaaccataccatcgttaattaacggactggcaagagccttgattatgtcattctgactcacctctttagggaggtgtcgaacataatgacggcgaaaatgaatatcctgcatagattcctctttgctagtcaggcatccaggcgctgtaaaatagtgccaagataatatttattaccttttaaccagacgttaccaaaatcaatggccaatcctctagagaaaaataccaactgttccaaatgcaaaacaggtgcgtcttcaccaatatcaagataatggcctcgctcattaccaattaatttggctgcgtaacggctttcagaaaaacttattttcttatcagataatctttctattgctgaaaataaattctccctggtaaaatctacatcaataataccggggcagagatcaatgttgatacgattttcaatcaacatgactttttcatcgccaatacaacgaaggcgtttaagaaataaaacatcttgtcccggtttgatactcagtttctctgctacaaagcggttagcgggttccagtcgggaggttatgacactggttgtgaagtttatcttctggctggctaaggcttcagcaaaggagagcaaaccttcacccagtgggtaagcaacattttccttctttacgaaagttcctttaccctgcacttgcacaagaacaccttcccggacaagttggtcaaccgcttttttaacggtaccgcgactcacctccagcatatccatgatttgaaactctgaaggtatccggtcatcctcaactaattctccgctataaatactttcccttatccactccacaacctgttgatacagtgggatgtgtgaacttttactcaatgttttcatggtgcgcgcctaaacatttagagttgtctatagacaatcatgtacaacttcgagtttatgataagaaattttgagacaggaggtatggcaaggagtcacagttttagtgttcaaaacaagatcacatttccgtgatatatgtcacggaaatgatgagctataagtctctgacgttttggcgtcgttagcggttattcggtgcgttacttctgtggttcacccttagcaaatacgatggcggctacgctttatttagttaacgatgaatcgcgccacccggccgttaatcgtggctcgccgcccttgccagcctcattcatctcgtcttttgttaacgagatagtgaagagtatcaatgcagccagtggacaccctcttccggctgaaaaaaggcgttatagcgcagttgaaacgcgttgatctcctgcatatcgggttccatttcgcgcaaaaagcccagcgccagccgtacctgtgtatcggtgatcggcgcggctaaacgcgctttttgcagcaaccgatgccaccgctgcaaattctgatcgccgccatcgacaatcaccatttgccagatcagtaacacctgagcggcattttgcaaatgcgactcatcagggcgatgcagatactgtaaaaattcaccgcccgccgttttacccatctgatcaatcatcgattctatcggcactacatcaatattcagacgttcgctcaggcggcgaatcgcccggcgggtatccgatgtcagcacccgaaaccccacaataaacaccaccacaaacgtggccagaatcaaccaaatcatgcgcacatccgtcaccaaacaggatgcccatcataacggtaaatttataactgtcgacgttctggcctgtcaggatgtgatttattaacgcttgtcttcatttacgccagacgccggatgtcctgtctgacgaacgcaaggcataaaaaagcccggcgttaagccgggcaaaacgttaccaaatgcacacatttaagcgatattgacttgctgaatttttttctcacggcggattttgcgctcttccatcacggcgaccatcgccatcaggcagatacagccgatcgcggcggcgtccagcgcggcgaacgtgcccgcccagccggtcagaccaaaaacgggggtgccgtcggcaatcatgcccagacccagcttggcaaagctatcgccgataagataagcgaaggtgcccttgataccgtccgcagcgccgatggcttttttcggtacgaaaccgacagccgccacgccaattaatagctgcggcccaaacaccaggaaaccgagcgcgaacagcgaggccagatagacatactggttgctggcgtgctggtagacgccgagggtggcgatgattaacgccagcgccacacaggctaccagcgcacgacgaccgttcgccaggtcagagagccagccccacagcaacgtgccgaccagcgcgcccacttcaaacaaggtaaagccctgaatcgccacctctttagaaagtttcagctcctggaaggcgtagacggttgaccactggtcgataccaatacgtaccacatacaggaagatattggagaaacacagcagccagatcactttgtttttcaacacatattcaacaaagatctgccacttggtcatttcgttttcttcagtctctttatcctcttcgctgatctcttcgccgaacagttcttcagctttacccagaccgtaagattccggggagtcgctgccgaaacgcagaccgataaagccaacaatcagcgcgataatcgacgggaagataaacatgccgatgacgtgaccgtcgaacaggtagttggcgccgaacagcgccacacctgccgcgcccgcgccgccgaggttgtgggagatattccagaagccgagaaaggtgccgcgtttacgacgcggagtccatttggtgatggtcgagtagctgcacgatccgccggtactctggaagaaaccgctcagggcatagaaagcgatcatcagaaacagactggttgaccccgcgcccatgctggcgctgaagccgagcatacagatagcggagaggatcaacataaacggtagaaactgcttggtatttttaccgtcagcgtagtaggaaaccagcgttttccccacgccataggtgatcgagaagcccaggccaatcatccccagctcggtcatgctcaacccgtaggtagagatcatgtcgttctgcgcgatgttaaagtttttgcggatcaggtacatggtcaggtagccgataaaaaccaccagataggactgcatgaacggcttgaaccacattttacgccgcacatcgagcggcagatccagggtcggcttgcgcacctggtttaagaaggccagcatggattactcctgagctaatttttatacctgcgaatggcaggcattgtaaaaatccacaggaaaagtggcctgcgacagcgtccaggcaaaaccgggaaaatttcttagttttgccccattcagcgcaaaaaggtgaggtgtatcacgcttcgtgggtctcgcgtggggcctgagcgttcagaaatggcaacagcaatagcgcggagatccccgccgcgatggcgatgaccgcaaaaaaaccggtccagtgccagatctccagcactttcgctaacggccagccggaaagcgacgcgccgagataggcgaacaggccgacaaagccggtggccgcgcccgccgcctctttatgcgagcactccgccgccgccatgccaatgagcatctgcgggccgaagacaaagaaaccggtggtgaagaaacaggccgcctgcatcacgtagctggcgaacggcatcagccacagcgaacccacagagagcaaaatcccggcggcgaagattaaattcatcggtccgcggttgccgttgaagagtttgtccgagccccagcccgccaccagcgcaccgataaatccacccagctcaaacatcgatactgccgtgttggccgtgaccaaatctacgcccagcgtctcggacatatacaggttgccccagtcgttgatcgccgcgcgcaccacgtacactaagacataacacaacgaaagcagccagatatagggattcaacagcacatatttagcgaggatttctttgcgacttagccccgcgccctcttgctgttgggcgacctccagcgcatcgtgccgccagtcgcctaccggcggtaaaccaatcgcctgcggacggtcgcgcagccgccagcagaggaccatgcccaccccgatggcaagcaacccggccaccatcattccgacgcgccagccataatgcagggcgacagcggccataacgagagggatcagcgccccgccgacattgtgcgcggtattccataacgcccaccagccgccgcgctcggtacgcgagtaccaggcagtcagcaaacgggcgcaaaccggcgatccaaacccctggaaaaaggcgttcagcgcccatagcagagcaaaggcccacagcgaggtcgagaagccgaacagaatattcactacgccagtcgcaatcagcccgatgcccataaaatagcgagcgttagagcgatcgctaacgatgccggagacaaatttcgacaccccgtaggtgatgtaaaacagcgtcgccagcaggccgatatcgctgcgggtcagaatgccgctggcaaggatttccggcgcggcggcgttaaagcttttacgggtgaaatagaacagcgcgtaacccaaccaaatggtgatcaggatatgccgccgccagtagcgatagcgggcgtcaacctcgtgcttatcggtgatgagcggcgcgttggccggggcttttaaaaacgaaagcattatccttccttaaacgtaacgctggggcaacgagacgctcacccgcgtaccgtgggtacaagagatggttagcgtcccgccgagcgccgacacgcgttcgcgcattccggtcaggccgaagccctgctggtgagagcccggcggcaggccgctgccgtcatcctcaatcaccagcatcagccgctcatcctgctgccagccctggagcgtcaccgcgctggcattggcatgttttacgatgttattcagcccttcctgacagacgcgaaacagcgtcacgcgctgactttcactcagcgccgtttcgtcaattcgccagtcgaggtgactgacaataccgcggctttccagctccatttcgcgcagcagcgaacggatggcctgcgccagcgttaagtcgtctaactggcgcgggcgcaagcgccccagcaggcgacgcaccgcgtcatacacgcccagcgaaagctgctcgataagttgcccgctctgcttcacgccgccgttatccgccgccagtcgttgcacaatgcccgcctgggtacgaatcgcggtgatggtctgcccgatgtcatcgtgcagctcacgcgcaacatcgcgccgcacgctctcttcggtctccagaagacgctccgccagccgatggttgcgcgccagctccttttgcaacgactggttcagctcgcgcagacgctgaatgcccgcgccaagcagtagcccggtcaggctttgcgccaacagcgaaagtaataaatcgacgggatgatcgtgccaggtctggctggcgatcagcgcgatagcgttcatcagtgtggcaatgagcgcgccctgccagccataatgccaggcgagcgcgataatcggcaacgccaggcagaacggcgtaaagcgcgaaagttcagcaggtaaacccagttgcagccacagactgacgataaacagcagcagataccagatcagatgccgcccgcgccagtttaccggctgcgataccagcgatggtcccagcggcagccaggtagtgctggtgagatagtgccagaaaaccaggcagatgggggccagcgtcagaccacccgtgagggtcagcagtagcgcgttccatgcctcttccccctgccccagccagggcagggattgcagtagcgccgcggcggtgagggccgcgccctgaagcaataacgtgcgccagtcgcgctgatggcggtaacgcgaagtcagcgccacgggcagtagcgtcaacacactaccgatcatcaaaagcggcagatgggccaacgcaacttcctgcgccaaccagtacaccagcagccactccgcgcccagcaatactggccagtatccgcgcgggcattgcagcataagtcccaggcgcaggccgaagggaaagagtagcgccgccagctccgggcgctctaccagatgcaggctgatactccacaggcagaaccacgcggcggagaagataaaaaagcaggcaacaacggtgattaaacgggaaaaaaaggtgttcattaccaaccgtcaaacatgcgatgcgccagttcaacgtcattgctgacgcctaatttttccagcagattcgcgcgatggacatgcaccgtttttggcgacagccccagctcggcggcaatctcttttaccgccataccctgggcgagtttttccgccacctgacgctcgcgtttggtcagcggatcttgccgacccgccgccagtttcacggcaatatcgggggtcaaatagcagccgcccgtcgccaccgtatgcaccgcggcgatcagttcatccggactacagcgtttagagagaaaaccgcgcgcgccggcgttcaacgcctgttccaccagcgccgggctatcgtgaaccgagagcacgatcgtcgccatcccttttggcagttggcttagcagctccagtccggaaatatccggcattgagatatcgcagatacatacctgtacgccgcgccccggtaagcctgccaacgcttcgcgcccggaaccaaattcggcgaccacctgcaaatcaggttccagccccagtagctgtgcaaagccggagcggacgataaggtggtcgtcgataagggcaacggtgatcatgggttctgtcctgatggataaaaaaaacgcgcttaccttaacgataagcgcgcggctgttcaagccttgagcggtcagacaatgcctgtcgtgacggtgaacgtccgggtttgctgcggttccagttgaagcaaggttccatttcgctgcgccgcgagaaaaccttcaggccgacaggtcgcgggcagggcaaaggcggcaacctgctgatcgccgttataaagaatccagcgggtcatgtaatttagctccgcgctggcgaaacgtgtcacgaacgtggtgccatccggggcgatcatactgaattccggggtatccgtgtacttgtccagttcatcggcgaagaacacgatttccgggtcgtaaaagtcaggctcgttgagcgttgccagcgaggcttcaccctgcaaaagtcgttgattaaacgccagccactgcgccgtgggtttgacatgcgccggcaccgactcgcgtagcttcagcgcggtatccgggatattctgacggaacgtggcgttcggcacataggcatagttcatgtggcacatgtactgtagcggcatggcgactgaagccaggttagtcactgtcatctgaatatcaaacagcgcgcttgttttacgcattaccaccgcaggttgcgcctgataatgatgaccgaaccccatcacatactcgtagcgcccggtcacgcgcagactgtcgccctctaactccagccaggcgtcgtccatggcagcgcagggcatctcgccgtgcagcggatgtgtatcttctggtgacgggcagccattcgccaatagtccggaatggaaagcaaagcaaccatacgttgccaccacttccgcagccggcttcggctggcggaacatgttgcgcatagtcagatcatgaccgtcaaactgcgcgtcccaaatcatctgccccatccagggcagaatcaccagatgaccgcggctgttttgtattttcagtccttccacgccgctggcgtaacgaaacgccgtaaccgtaaaatcatcattttccagcaagatacgcggctgctcgctaaaaagctcccgccataatgtaatacgtgttgtcatggttgatctcctcaggacgcggcgacttcagccaggttgccgcgcactttgctttcgcgccagaagtaaacgccaacgtaaacaaagcacagcatggaaaccaggaatgagagctgtagcgagtggaacatgtccgccacgtagccctgaatcgcgggaaccaccgccgcgccgacaatcgccatcacgatcaccgcccccgccatttcggtatgctcgttatcgacggtatcgagcgttccggcataaatggtcgcccagcaggggccaaacagaacactgaccagcaccgccacgtataccgcgctaaagctgggcgccagcgccacataggccaggaacagcgcgccgatcacagagtaaaggatcaggactttttccgggttaaagcgtgtcatcagaatgttggcgataaacttgccgataaaaaagcaggcgaagctgtagaccataaaggttgaggcatcgcgctcattgatatcgcctaactccagcgccagacggatagtgaacgaccagaccgccacctgcattcccacatacaggaactgcgccacaataccgcgacggaaacgggcgttgctggcgagatagcgtaacgtatccagcgccgaggggcgtttatgactcgcggtttgcgcgactttacaggtcgggaaacgcgtcagcaggaacagtaccatcaccactaccagaaccataatcatgtacttatagggttccagagtgttttccagcatcagcaccttgaagttgtggacctgctcggcattcatgcccgccatctgtttttccaggctttccccttcggaaaagaccagatatttacccaataaaatgcctgccgccgcgccgatcggataaaaggtctggctgatattcagccgcagcgtggcgtaggctttcggcccgatcatcgaactgtaggtattcgccgccgtttccaggaaactcaggccaatcgcaatggcgaaaatcgccgcgaggaacatggtgtaggtcgccatgtgcgacgccgggaaaaagagcgtacagccgacaatgtatagcgtcaggccgataagtatcgccactttataactggtttttttaatgaccagcgaggccggaatagcaattaaaaaataaccgccataaaaggcgctttgtactaatgccgaagcaaagttgctcagcgaaaatacacttttaaattgcgtaatcagaatatcatttaacgcggctgcgcatccccataatgggaataaacaggataacaaaataaactggaacagaggtgtcttattcagatacccgtcgggcatctgaacgatgtttttatcgttcatagtgctacctttaacagtgcagggtgattgttattcgttcaacgaaagatactcattaaattgctcaatacttggataagaggattgggtgcctttcccggtgacgctgaaagcggcaaagagaacggcttttttcatggcggcttccacatccccgctctggacgtagtaatgcgcgaaacagccgataaaggcatcgcccgcgccgctggtatcgacagcgttcactcgaaacgccggaacatggacttcctggtcacgcgtcatccacagcgcgcctttctcacccatggtgacaataatattgttcagccctttatctaccagcgaacgtgccgctgcgcgaatatggtcataggtatccactggcataccggttaatatttccagctcggtttcattgggtacaaagaaatcgcatttacaggcataagacatatctaattcccgtaatgctggcgcagggtttaataacacttcaatcccgtgtttcttgccaaattctattgcgtgataaaccgtttcaagctgaacttccagttgcagaacaataagctggcatttttttaaatcttccgccgcgcgatcgatatcttccggcgagagaaacttgttagcgcctttgatgatcagaatgctgttgctggagttggcgttgacgaaaatcggcgctacgccgctgctggtacacggtactttttctacatacgtcgtattgatcccccaggattcgagattacgaatggtgttgtcggcaaaaatatcgtcgcccactttggtcaacatcaatacttttgaattgagcttagcggccgccacggcctggttcgccccttttccgccgcagccgattttaaacgccggcgcttccagagtttccccttctttgggcatctggttggtgtaggtgataaggtccaccatgttagagccaataaccgcgatatccattttactccctctcagaaatcgtcacacgacaatgatattaaaataacattatcatgttacttccgtatcatttgtgactatgatcgcgattagaggatcattttgccatttacttcgtgaacaatccctggcggaacatacgcgcaccaaatcatttttattgttacaatttactgaaaattaactatttattgttataaaacgcgaataaacccacttttatttcctgacagccggacgtatagtagtgccacactgtaatgttctcagaaacacataaatgttactgatggaacataacaacatgatttgcggagagggtgaatggagaccaagcaaaaagaacgtatccgacgcttgatggagttactgaaaaagaccgatcgaatccatctgaaagacgccgcgcggatgctggaagtttcggtgatgaccattcgccgcgatctcagccaggatgatgaccctttaccgctgacgctgctcggcggctatatcgtcatggtaaataagcctgcgtcttcaaccaatatgccgctgccggcgaaaaagacgcatcatcgggacgaccttcccgttgcgatcctggccgccggcctggtgcgtgaaaacgatctggttttttttgataacggtccggaaatgccattagttatcagcatgataccggatgatattacctttaccgggatttgctactcgcatcgggtatttatcgcgctgaatgaaaagcctaatgccacggcgattctgtgcggcggcacctatcgggccaagagcgatgccttttatgatgccaataatccttcggcgctggattcgctcaatccgcgcaaagtgtttatttccgccagcggcgtacatgaacattttggcgtgagctggtttaacccggatgatcttgccgccaaacgtaaagcgatggaacgcggtctgcgcaaaattttgctggcgcgtcacgccctgtttgatgaggtcgcgcctgccagcattggtccgctttctgcctttgatgtcctgattagcgatcgcccattaccgacagattatgccgttcactgtcggaatggttccgtcaaagtcatcacgcctgattcggaaagtgaataacttactcaaaaaagacggcaattttattgaacatggtgggatcggactggtttcgtaccaccttcgccacgtcttccagtttatcgatctgactgatcatctgttcaagtcgctgatcgtcattgaccagaagccagatgcggctctgatcgctaccctgaatcggtaaacagagaataccctcaacgttgaaagcgcgtcgggcgaacagcccgcagacgtgggtcatcacgccaggatggttgcgaacggtcagctccagaataacgttatcatgtgattgtttctgcatggcttattcccccaccatctctgtatttgccgcgcccggcggcaccatcggatacactttttcttctgcatcaatgcgcacatggatcaacgccggtccaggacgacgaatgatagcctgcaacgccgcctgcggatcggcttcgttattcaaatcacaggtgtccagaccaaacccggcggcaatctgcataaagttgatgcttcccggataggtcgccgcaaaaacgccctgtttatagaacagactctgttgctgatgtaccagtcccagcgcgtcgttattcatcaggatgattttcacatccaactggttttcactggcggtagccatctcctgaatattcatcatcaaactaccgtcgccggaaaaacacagcaccttgttgcccggattcgccagcgccgcgccaatcgccgcgggcagaccaaaccccatggtgcccagcccgccggaagtcagccactgacgcggacggttgagcggataagcctgcgcggtccacatctgatgctgacctacgtcagtggtaataatcgcgttgtcgtccacacaggcggcgaccgcgttaatcagcccatagtgactaagcgggttattttcctggggaatactgcaagggaattcttgctgcaagtccgccaccaactgatgccatgcttcccgcggctgtgcctcgatatggggaattaactgtgccagtacatcatcgacatccgcctgaatagccacatgcggctgcttaattttgcctaactcggcgcgatcgatatccacatggatgattttggcgttcggacaaaactgctccgttttgccaatcgcccggtcatcaaaacgcgcgcccagaacaatcagtaaatcggcctcttgcagaataaaattggtactgcgcgcgccgtgcatccccagcattcctaacgacagcggatgcgccttaggcagcattcccagcgccattaaggtcattgtcgtcggcagttgcgctttttccgccagttcgcgcacgcgtgtcggcgcattgatcacgccgccgcccagatacagcaccggacgcttcgccgcgttaatcattgcggcggcctcgcggatactctccgcgctaaactccggcgggggtgatttttccgccggcgacggcaacgcatccagctcaattgtcgccgtctgcacatctttaggaacgtctatccacaccgggccgggacgccccgactgcgccagacgaaaagcatcgctcatcacctgaggcaactcattgatatttctgaccagatagttgtgcttggtgatggggatagagataccgtaggtatccacttcctgaaacgcgtcagtaccgatcatggacgccggaacctgcccggtaatacagattaacggaatagaatccaggcgcgcatcggcaatggccgtgaccagattggtcgcgcccggcccgctacaggccatacaaacagcaggtttaccctccgtccgcgccatcccctgcgcaataaaccccgcgccttgttcgtggcgcgccagaatatgacggatttgcgtactttggcttaacgcgtcgtaaacggggaggatcgaaccgccgggaatgccggtgacgatacgaatcccctggcgctccagaaaatgaacaataaattccgcgcccgtaaagcgctgaggtgtagatgttgtgcccgaacttgccatgctccattccttttattctgagccgacgttccgggaaggtgtcttaaacaaaaaaccccgcccggtttgcgccggcggggttttggaatcgtgtgtgttccggaccctacggcgcattgccgacgaccaccaccacacgcacgacgaccactgcgcgagatggcgcagttgttagtagggtcgcgttcagcatggaagggttcattaggggccttgtctgtttgttattaacacgttttatacaagcacagcgctttcagcatgacaacggaaaaattttcatctgcacaaaaatgcgtcagcgatcacatttttctacgaatttacacgctttgagtataggcgtgataagcgtagcgccctccggtaatcgccgggattgatgatcacgcatttcacaatgccggaaaacaaaaaacctcgccgaagcgaggttcttacagcgtaatgcgggtggtagccgcgaagcacactgtgttatgtcaacagcagaagtatacgcgttctgtgcagaacgcgcaatttcggcgcgaattttgatgaatttgagtatggatcagaagctccgttctgtctataaattactgttcatttatacagtacttaactataatgtctttgacacaatgtgttatgcgggggccgcatcgtaaaccggcgcaacgaagtcctggctgaaacgggtggtgccgtcagcgccttaaccccctcgtgagcacactgtgttatgtcaacacgcacactattcctcgcaaaagggatcgcgtgcgcaacagctggcaacaggcagcggaaaggtacgtcggctggcagtgctccttaaccacaggagacgcgtatgagcgtagtggatatcaccattcttatcctgaaactcattgttgcagcactgcaactgcttgatgctgttctgaaataccttaagtaattcagattcaagccgcaccgaaggggagcgggcaaccgctcccctttcaccttatccgctggtctttcgcttcccgggtatgttacgtttttatgacaccctcaacgacgcctgacgctatgaccctttccgttttctgcattttgctgttcgccgcgctgttacatgccagctggaacgccattgtcaaagcgggaaacgataagctctacgccgcgatcggcgtcagcggttccgcggcggtcatggcattgatccttttgcccttctcgccgcagccagcccacgccagtatcccttttttagcggcctctaccgcgctccaggtggtgtataccgtcctggtggcgaaaacctatcaggtctcggacatgagccagacctatcctcttatgcgcggcaccgcgccgctgctggtggcgctcattagcgttctgtttcttggcgacagcctgtcgtcgctggcctgggtcggcatcgcagtgatctgcatggcgatacttgggatggcctgtaatggccgcgccagctctcaacgtggtgtcgtgctggcattaactaacgcctgttttattgccggatatacgctggtggacgggaccggcgtaagactctccgaaacggcgctgggctatacgctatggtcattttttctcaacggcgcctgcctgttaacctgggcgatgattgcgcggcggcgggaagcgtcgcgttatctggcgcaacagtggaaaaaaggcatttttggcgggattggcactatgggatcttatgggctggcgctatgggccatgacccaggcgccgctggcggtggtcgccgcgctgcgtgagacgtcgattttattcggcgcgctgatagcctggctgttgcttaaagagaaagtggccgggctacgtctggtggcggctggcgggattgccctcggggcgattttactccgtctgtcatgatcgcccaatgacagccgcagacgtaacacattctcggcaacatttgttgccgcttttgtttacatatcctgccgttccttcgtctgccattgctggttgctgtctggccttctttttctggtgtgatagattcctctcgcatttatgggaatgcgcagcaagttattcttattttttctttttttgaaaagtaatcagcgaaatgaaaaggcagagaaacgtcaatttgttgttgatgttggtgttactggtggccgtagggcagatggcgcaaaccatttatattcccgccatcgccgatatggcacaagcgctaaacgtccgggaaggcgccgtccagagcgtaatggctgcttacctcctgacctacggcgtctcgcaactgttttacggcccgctttccgaccgggttgggcgccgccccgtaatcctcgtcggcatgtctatttttatggtagcgaccctgttcgccatgaccacgcatagtttgacggtgttgattgccgccagcgccatgcaagggatgggaaccggcgttggcggagtaatggcgagaacgctcccgcgcgatctgtatgaaggaacgcaacttcgtcacgccaatagcctgttaaatatggggattctggtcagcccgctgttagcgccgctgattggcagcctgctggataccctgtggaactggcgcgcgtgttacgctttcctgctggtgctttgcgctggcgtcaccttcagcatggcgcgctggatgccggaaacccgccccgccggcgcgccgcgcacacggctgatcgccagctataaaacgctgtttggtaacggcgcatttaactgttacctgctgatgctaatcggcgggctggctggcattgcggtctttgaagcctgttccggcgtgctgatgggggcagtattaggtctcagcagtatggtggtaagcattctgtttattctgccgattccggcggcgttcttcggcgcctggtttgccggacgcccgaataaacgcttctcaaccctgatgtggcagtcagttatttgctgtctgctggcaggccttatgatgtggattcccggctggtttggcgtgatgaacgtctggacgctactcatccccgctgcgctgtttttcttcggcgccgggatgttatttccactggccaccagcggcgcgatggagccgtttccgttcctcgcaggcaccgctggcgcgctggtcggcgggctgcaaaatattggttccggcgtactggcgtggctttcggcaatgctgccgcaaaccggtcagggcagtctgggattgctgatgacccttatgggattgctgatcctggcgtgctggctgccgctggcgtcacggatatcgcatcaggggcagacggtttaacgtttccctcgcccggcgttttgccgggcgtttcacattccggcgcgatcatcgcattgagcagggactcctgcgccggacgccacgctccttcttcgccgtcataaaactgagtgtccgcgtttatcgcatacggaatatgcgcttttttcagctcgcaggccataaaacgggcaaacgcgaactgtgaagcgaccggcgtcatttttatcgactctcccggcgcccatccgcccacccagcttgcatggccggtcttatgctgccagcgaaccgcagcgttgatccgtgcccgaatcgccgctttttccgccgccgtgcctgacgtccacggatatttaccgccgcttttcaggggtccccacgggaagatgtgccactccgccagtacatagttctggctttgcgccggcagtttaagcgccgacaaatcctccggcgcggcgcgcatgcggggggcaacgaaaatcatccgctgtgggtcaatggcgtgaatcaggcggatggttttgtcatatacgcgattcagcgacgccatattatgattaagtttgtcggcaggctcataaatgagatcgaaccccagaagcggggatgtctgaccaaaatagcgcgcgaccacgctccaccagttgatcagctccttttcatggctggcgctgggatcggttttatacgcatccgcctgataggcaataatgggtatgacgccatagtattcgcaggcctctaccagcttacgcaaatggatgaggcgcgcttccgtcggcgcgcctgccacacgaatacggacatgcgttaacccttttgccttaaaatcccgcacgaccagcggatcaaactcgcggataccccgttccgttcgcgcccagtcaacatccatcccaacgccaagctgctgcgcatagcgcgccgccgtcaaaggcatcggtttcgcatagacgaccgcgctggtcagcatgagagaggcaataagcggtttaaacacgacgccccctaaaatttttaccacggtgatagcacgtatttagcatattcactcccggcaggtgtagcgacaaagcgtaataaatcttcacacctgttcctgcaaccagcgaataaatgcctcgattttcggccactgcctgccaggcagagtggtgacataataatgctgatgacatttcagcctcatgtcaccaaaaggcgcaatcagttcaccgctgtcgagacgcttttgcaccagccgtttacgccccatcgccacgccaatgtggttcatcgcggcaatcaccgctaaatcagaacgatcgaagccaatgccggatgaatccggcaaatttactgcaaaatgctgcgcccaactgtgccactcatcggtgcccgaatcgttactccacgcctgtctgtcgtgtaagagcgtacagtgccgtaggttattcaggttatcctgcaaggcgaaacgacgggcataatccgggctgcaaacgggcaaaatcgcctcatccattaaaaaatggtgcgtgagctgcgccgacggcgcatcgtcaaaatagatagccaggtcaatgccggcacgctgtaggttaacgttatcgttgccggtcagcatagtgagagaaattgacggatagcgacgggtaaagtcccccagcgcaggcaccagccagcactgggcgatagagggacgtgaatacacggtcagcgtgccggacagttcctgatttttgatatcgaggatttcctgattcaacgtatccagcgacgatttcagcgcccagaatacccgtttgccttcatgggtaagctccactttacggtgagagcggacaaatagctggattcccaactcggcttccagttgattgatacgatggcttaccgcactggggcttaacgacagctcatctgccgccagagcaaaggactggtgtctggccgcgacttcaaaagtatagagtttggataactgccagccgttgagtaagcggtttcgggtatcgcgaaggggttccatggcaacctcagtcatcttttaatttcccgaagtgtaaaaaaacgcgctgaaaaaatccgcacatagatgaagtaaaatgaaccatatcgcaaaataaaggcaatattagatggaaatcacatagttgattcaatttacatcatgtgaatggcaaattatatcgtttgtcagggtgtgctgtttttctgtccaataagaacagattaatcacagggtaggtgagatatgcacgctcaaatctgggtagtgagcacgctgctgatcagcatcgtgttaatcgtattgaccatcgtgaagtttaaattccaccccttcctggcgttactgctcgccagtttctttgtcggcgcgatgatgggcatggggccgctggagatggtcacggcgatagaaaacggaataggcggtacgctcggttttctggccgccgttatcggtcttggcaccatcctcggcaaaatgatggaggtttccggcgcggcggaacgcatcgggcttacgctccagcgctgccgctggctctctgctgacgtgatcatggtactggtggggctgatttgcggtatcacgttgttcgtggaagtgggcgtcgtgttgctcatcccactggcgttttctatcgctaaaaagacccatacctcgctgctgaagctggccattccgctgtgtaccgcgctgatggccgtccattgcgtggtaccgccgcatccggctgcgctgtttgtcgcaaataaactgggggcggatatcggctcggtgattgtctacggtctactggtcgggctgatggcatcattggtcggcggtccgctgttcttaaagtttctgggtaatcgtctgccgttcaagcccgtaccgacagagtttgcggatcttgaagtgcgcgccgaaaacaccctgccgtcgctgggcgcaacgctgtttaccgttctgctgccgattggcctgatgctggtgaaaaccgtcgctgaactgaatatggcgaaagacggcacgttgtatacgctgctggagtttatcggtaatccgatcaccgcaatgtttatcgctgtctttgtggcgtattacatactcggtctgcgccagcatatgggtatgggcacactacttacccacaccgaaaacggctttggcgccattgcgaacatcctgctgattatcggcgcgggcggcgcgttcaacgccattctcaaaagtagcgggctggcggacacgctggcggtgatcctctcaaatatgcatatgcacccgattctgctggcatggctggtagcgctgattctgcacgcggcggtcggatctgcgacggtggcgatgatgggcgccaccgcgattgttgcgcccatgctgccgctctatcctgacgtcagcccggagatcattgcgattgccattggttccggcgccattggctgcacgatcgtgaccgattccctgttctggctggtcaagcagtattgcggcgctacgctgaatgaaacgtttaaatactatacgacggccacgtttatcgcatctgtcgttgcactggctggcacattcctgctttcctttatcatctgatcgtaaagagacgtactatggaaaacatacaaaagctcatcgcccggtatcctttggtcgaggatctggtcgccctcaaagaaaccacctggtttaacccgggcgccacctctcttgcacaaggtctaccgtatgtcggcctgacggagcaggacgtaaacgccgcccatgaccgtctggcgcgctttgcgccgtatctggcgaaagcgtttccgcaaaccgccgccgctggcggcatgatcgaatctgacgtggtcgctattccggccatgcaaaaacggctggaaaaagagtatgggcaaacgatcaacggtgaaatgctgttaaaaaaagacagtcacctggcaatctctggttccattaaagcgcgcggcggcatctacgaggtgctaacgcacgcggaaaaactggcgctggaggcgggtctgttaaccaccgacgatgactatagcgtgttgctttcgccggaatttaaacaattcttcagccagtacagtatcgccgtcggttcaaccggcaatctggggctatcgatcggtatcatgagcgcctgcatcggttttaaagtgacggtacatatgtctgccgacgcccgcgcctggaaaaaagcgaagctgcgtagccacggcgtgacggtcgtagaatacgaagatgattacggcgtggcggttgagcagggccgtaaagcagcgcaatccgatccaaactgtttctttatcgacgacgaaaactctcgcacgctatttctgggctatgcggtagcgggccagcgcctgaaagcgcaattcgcgcaacagggacgcgtcgttgacgccagtcacccactgtttgtttatctgccgtgcggcgttggcggcggccctggcggcgtcgcctttggcctgaaactggcgtttggcgacaacgtccactgtttctttgccgaaccgacccattccccctgcatgttactcggcgtttataccggtctgcacgatgccatctcagttcaagatatcggtattgataacctgacggcggctgacggcctggcggtaggtcgcgcttcgggttttgttggtcgggcaatggagcgtctgcttgacggcctctataccttagacgatcaaacaatgtatgacatgctgggctggctggcgcaggaggaaggaattcgactggagccatcagctctggcggggatggccgggccacagcgcatttgcgcctccgtcgcgtatcagcaaaggcatggattcagtcagacgcagctcggcaacgcgacgcatctggtatgggcaaccgggggcggcatggtgccggaagatgaaatggaacaatacctggcaaaaggacgctaatactcactcagtgccggaaagacggcagcgccatccggcacgccatcgcctgatggcgctacgcttatcaggcctgtgacgttaacgcagcatcgccatcaactcctccggcgagcgatgctgcttcagtaaatcccgcatcacccgcatatgcggcgaggagtagttaaaaaaggtctggtagccctcgcaaagctgatttttcccctggctatcccgatgctcagggcatccgccgccgcaaaatcgtaataaagagcacttctgacattcagcgcttagcggcaccttgtccggcgcttcggcgccattcctgccgccgcaccactgctgtagcgtctcatcaaaaaggcgaaccgagatacgctgaatatcttcacgtacccaaatatcaaatacgctatttaaaaaccgcccccagtctgctgaacacaatgaatcctcggtcaacattccgttccggtcatgttccaacaatgggataaaatggacattgcgaatgccgagccgttgtaagttacggtacagttgctgagggcgctggctattctggcgatttacgacgacctgaatctggtcatcactcacgacaatgtcctgacgtcctgtcatataaaattcccgataaatgcaataagttggcgaatatgggtaacagcaaacaggattgcgagcgacaacaccgcgagggagatcaaaaatttgtcacgcacgacatgagtttcggaaaaatcgctatgcgcgacatccatcaaattacgactcagggtataacgccaaagaatcaccgccactatcgccagaacgctgattgacacccagaacaagaaccccgcctgatgccagtggtgcctgacggctaacgccattaacgccccgtatcccagcagcgtgcgaaaccaggccagcgacgtacgctccggttgcagtcccggatcgttctgccgacgggctttacgactatccggcatacagtaccagccccatcactatcaccgcgacaatcatcaaaataacgctgatgatcaacaggctatgggtatagggcaaatcctctttcaggcgcatcgctttttcattacgtaaccagcgtagatagccataaatcgccaggccgcccgcaaacagacacaacaatagcgccagcagttcacggatcaccggcgtggcaaaatccggggcgagctgatcaagaccgacgcctgccgccagaaatcccagcgaggtgcgaatccacgccagaaaggtgcgctcatttgccagtgagaagcgataatccggcgcttctccgaggcgggaaatcttcatgacgactccttttacgttcttatgtattcccgttcgttttcagaataccactcacgttgttgctgatatgcttcacattatcccgcagcaagggaatcttattgcaaaataactgtagttcactggtgatgcgttttggcgcaaccgcgctcattgccgctatttttcatttcagttacgacctttttcaacgccaccgccaggaaaggcattattgccgaattaaaagctgaaaaaccacccgtcgcgacgaaaaaaaaggcgaagaagattgataactaactgaaaaaaattggaattatgctcgttggcattacgctgattagcgcgttcattgaggaaagagataagaagaagagcagaagtgtggccggtgcggcgcgcgttatccagcctggatttaacacagtgcgtaggccggataagcaacgcgccatcaggcgctaacccattccccaaaaaatcaccgccagcagttgtggcgtgataatacgcaggaacatcactaacggatagacggtcgcgtaagagagcgccgccgcgccgctggtggcatgaagattgttggcaaatgccagcgctggcggatcggtcatcgaaccggccagcatcccgcacagcgtcagatagttcattttggcaaaaatccgcgccagcaaaccgacggtaatcagcggaatagcggtgatgaaaataccatagccaatccagcttaatccttcgccctgcgtcagcgtatcgacaaaatcgccgccggatttcagcccaacgaccgccagaaacaaaacgatgcctaactcacgcagcgcgaggttggcgctcggcggcataaaccagtacagcttaccgatgctgccgatacgccccaaaattagcgccatgatcagcggcccgccggccagccccagttttaacgcgaccgggaatcccggcacaaacaacgggattgacccaagcagaacccctaatccgatgccgataaacaccggcagcatctgcacctgctggagtttttgctgcgcgttgccgaccacattggctaccgcatcaatcgaggctggacgccccaccagattgagaatgtcgccaaactgcaggctagcgtcactactggcgaccagctcaacgcccgcgcggttaaggcgggagataaccacgtcataacgctctttaaagtgcaaatcgcggatacgtttgccgagcactttttcgttggtgacgaccacacgctcgacgcgtaaatccgtgccacgcgtcgacaacgaggtgtccacttccttgccgatcaccagttgcgcgttatgcaggtcggtagattggccgacgaggtgcagcaggtcgcctgcctggataatcgtccccggcgacggcaccatcagcgtgtcgtcgcgtttcaggcgtgagcaaatgattttatcgctgttcaggatcggcacatcctggatagccatattattgaggttcggattctcgacacggatattcattgtctgaattaatgaatggccgttagcgagagaggattcgtgcttctgcgcctccgcctcgacgttaacgcgaaaaatcagccgcatcagccacatggtgagcaaaataccgcagatgccaaacggatacgccatcgcatagctcatccccatctgatccaccagatccactggcgttcccagatcgcgcaggatttgctgacccgcccctaacgcaggcgtattggtgactgcgccggagaaaatccccagcaccaccggcagcggaatagcgaaaattttatgcagaatcgcggtgaccaacccgcccataatcacaatcagaacagcaaacagattgagacgcagcccggaaacgcgcagcgaggcgaaaaaccccggccccacctgtatgccgatggtataaacaaaaaggatcaggccgaattcctggataaagtgcagcatatcgccactcagcgtcaccccagcctgatcgacgaagtggccgacgataataccgccgaacagaacgccgccaataccaaagccgacaccgcgcactttaatgttgccgatccataaaccgacaaccgccaccaacgccagaacgctgaccgtcaatgcgatatcactcatcttttcttccctgtgagtaacatttcaatttatagggattatgactgaaccgttaaggcatatatacagcatggcgcacattctcatgttagaaaaccgcccagacgtcctgacttcggcagcgtcttaccctttttcgtggcataaaaaaagccccgccatctctggcggggcaaggcaaggagctcattagctatttaatgcggagcgttcgttaatggcgatacgctgcggcgcaatggtttccggctcgttgcgggttaaatcaatatgcagcaggccgttggtaaacgtcgcgccggaaacttccatattctcagccagcgtaaagctcaggctaaaaggctgcatgaccaggccctgatgtaaccatttgggctcgttttccggctgttccggcgtacctttcaccgtcaggcgcgtgccttccagttgaatatccagatcttcctgacggaaaccggctaacgctaaggtaatgcgataatggttatcgtcgcttttttcgatgttatagggcgggaagctctggctttcgccgctgttttgcagcgcattggccagcttgtcaaaaccgatccattgacgcagcagtggggataaatcgtagttacgcataatcatttctccttctaagaagcgagtttttaccttcacactttacgtgcgaatatgctccctgacggcgagcatgggatgacaggccgcgcaacgcgacccgacggaatcagttaatttcgatacggcgcggtttgttcgcttccggaatcacgcgctccagttcgatatacagcagcccgttgaccaggtttgcgccgcgaacgtgaatgttctccgctaactggaacttacgttcaaagttacgctcggcaatgccctgatacaggtaagtacgttctttctgctcgtccgcatgagcgccttttaccaccagtaaattatcctgggcagtaatctccagttcgctttccgcgaaaccggcaacggcaatggcgatgcggtagtggttttcgtctaccagctcaacgttgtacggagggtagccgccattactttggctttggttattttcaagcaggttaaacagacgatcaaaaccaatggcagaacggtacagcggggataaatcaaagttacgcataatcataaactcctgaaatcagcgagaatgtcagaccttccatcatggacaggccaggattgccagaacacccatcaggcgtgcccttctattcactacgtcttataaatgggtctgaatacgtacttttcaagtattttaatccggcttttttttgcagtttattggctattgcatagactggttgggacagcactgattgttaaagtgcgattaccgccacagtgccacgtactggtgatgttatttttagcaacggatcgctataactcatcatgcaaataacgacaaccaacagatgaatgagtgatgataaaaaacgtgtggttaacgctgataatatggaatgggatgcttttattaagcggttgttcaagcgtcatgtcgcacaccggcggtaaagagggtacttatcctggcacgcgcgccagcgctacgatgatcggtaacgatgagacaaactggggcaccaaatcgttggccatcctggatatgccatttaccgccgtgatggatacgatccttctgccgtgggacatcttccgcaaagacagttcggtaagatcgcgcgtagagaaaagcgaggaggagacgaaaatgaccaatgccgtcatccccccggcgaagatgcctcctccctgatttatcgcccggtttccgtcacccatagctgacggaaccctttcacctcttccatccatgcgacgtgtcgcccatccggtgaaaaaacgacggcgtccgcagacggcgggttgtcgtgcctggcggttaagaagtcgatcctcccactttgtgcgtcgcagcaggcaatccggttttccagcaccagtcccagccatttacccgacggatgccagttaaacgctgactgtacgccggtcgcatgatgcgttaactgccggggctcgcctccctgcggcgatatcagccacagttgcgctacgccgttatcgtcccgcatcaaaaaggcgatcgccgtcgcctgcggattactgcggacccagtggcgtggttcgttagtgagtccaggataaacacgctggtgagtaaaggtaagacgccgctgaactacgcccaacggcggcgatggcatcgttgattcggttcccgtcagcggcgtgtcgcctgcctgtttccagccgttttcatgacacggtaaatcgacaataaacagctccgggacttttttgcccgtcagcgacagcgtatcgccaataaaggcgatctggcggttgcccacccagccctcttcataggcgcggttaatgtcatcgctgccaggtctcggcgcaggcgtcgtgcggctaaccagtacgcaccagtagctaccgctgtattcgcgcggatgctgaaccggtaccgttaccggcccatacggcacggccacgccgacattacgtagatccagcgccggatctcgctcatgcagaacgtggtcattataggtaaaactcaccagctcgccgttcgggctaaacacatggacgtgactgccgccgcgcagcgcgccgggagtatacggcgcagtaatatccatcgcatcgaggttagtcacgccccccggcgttgcaataacgccccggcggtggtggaaatcgtaatgccacgtctcatcagggttttcagggccatgaataaacacatagtgattgtcggcaggatgcaccgtcaccacaccgacatgcgcgccctgcacagcgcgataaatcacctccacgtcgccggtatgcacattgacacgctcaatggtcttgcccgtaaatgacgcgcctgaaggccgtacatcaaagaccagccactggctgtcaggtgtccaggtattggtgttggtaagctggtgatggcgcggcgtaaaagtgatttgtttcatgggatgtcctgataagagacgatgctcgtcatcatactgcacacgggcttcactttcaggctttagcgtatcgttgggatagccaggcccgatggcgccacgccaccgggccgtcagggcattatttctcctgcgccagccggatactgcgctctatcaccgcccgccgggcgtcacccgccggcagcagcttcagcatcatctcccaggccgccaccgcctcgccaaagcgctgctgctcaaaggcgttaaacgcatacaggcttaacacccggatatccgtgtggtcgcggctcaccagccggcgcagcagctccccgccgcggcggttatcctccgggtcggacgagcgcgtcagcgcctccgcgtagcccagcgccgcatcgcggtttttcgggtccagacggtaagcgtttgcataggccccggtggcggtaccggcattacccagtaccataccggtgcgccccagcatgagccagccctcaacattgccggcatcattctgcaggcgggtgcgcagccccagcgccagccgcgccatctcctcctcattcagcggctgcgcctgcgggtccagcgcccgcgccagcagcccgggcgtctgcgccgttgcctgctgccaggccctgacctgcggatagctgccggtcagggcgtagctgccggcgccgaccgccagcgcaatgacggcccccggcacgtaaacgccccacccggcgcgcgcgccgcaaaccggggtgtccgccggcagcggctcccggcgcaggcgcacccgccggcgcgtgcgggcgacgattatccacccgcccgccacgatggcggccagcggcagcacccacagcagcaccgtcagcggggtcagcggcgggtcgtaggtgacgaagttgccgtagcgcgccaccatataatcgatgatttcctggcggctcttcccctcctgcatcaggtcatacaccctgcggcgcatgtcggtggctatcatcgcgttcgagtccgcaatgctgttgttctggcatttcgggcagcgcagctgctccgtgagctggcggaactgctgctcctgcgcttcatctttaaacggcatcacgtcggtggttgcccgcgctgacccggagataaccagcgccagcatcagcatcaccatgcccggtaacagtctcattgcgccgcctcccggctgtatctgtcccacagcggtttcagttcactttcccatacccgggcattcaaatcgcccgcatggcggtagcggataatccccctgccgtcgatgaggaaggtttccggcgcgccgtacacgcccaggtccagccccagcatcccgtcgctgtccgataaactcagcgcatacgggttgcccagttcctttaaccaggccaccgccttcgcccggtcgtccttatagttcagccccaccacccggataccctgcgcagaaagctggttcaggtactgatgctcggcgcggcaggtcgggcaccaggtggcccagacgttaagcagcaccggtttcccctgcgtcagcacctccgcctgatagtactgacccggcgtctccagcgattccaggcggaacgccggcaccggctttccggtcagtgccgattcgagattcgtcgggtcatccccctgcgcgttgcgcgccagctgccacagcagcgccgcggcaatcagcagaaaaatcagcagcggtaataacagtacgttgcgtttcatccggcctccggcaatggtttacggcggcggtagcgcgggtccgccaggcacagcagcccgcccagcgccatcagcagtcccccggcccatatccagcggacaaacggtttgtagtacaggcgcacggcccacgcgccgttgtccagctcctccccgagcgcggcgtacaggtcgcgggtcagcccgccgtcaatcgccgcctcggtcatcaccatccggctggtgttgtagagccgtttctccgcgtgcagcaccgcctccggctcgccgtggcgcgtcaccccgatgagggccaccccgccgcggtagttgggcccggtgatgtcccgcacctcccggaaggtgaagcggtagtcgtgaatggtcacgctgtcgcccgcccgcatccgcacgtcacgctccacgctgtaattctggctgaaggcgatgccggtaatcgtcaccgccagcccgaggtgcgccgccaccattccccagtagctgagagaggttttcgtgccgcgggacacgcgctgtacggcttcggccaccgccagcaccgcaatccagcaggccatcgccatccccaccgccgtcatggcgatgattttatcttccagcagccatggcaaaagtaccgacagcaccagggtggagaccagggcggtgagcagcagcgtcctgatgttacgcggccggtcccggccccagcgcaccagcggccccacccccagcagcagggcaaaggggaccatcagccaggtgaacatggtgttaaagaacggctcccccaccgaaatgctgcccagccccagctgtttgtgcaccagcggcagcagggtgcccagcagcaccaccagcatggcggccatcagcaggacgttgttgccgagcagcagcgactcgcgcgaccacagcgcgttgttcacccgcgaacgcaccctgtgcccgcgcacggcgaacagcagcagcgagccgccggtgaccagcaccataaaggcgaggataaacatcccgcgcgccgggtcggaggcgaaggcgtgcaccgacaccagcaccccggagcgcaccaggaaggtgcccagcaggcacagcgagaaggcgcagatggacagcagcagcgtccacgccttaaagccggcgcgctgttcggtgaccgccagcgagtgcagcagggcggtgcccgccagccacggcataaaggaggcgttctccaccgggtcccagaaccaccagccgccccagcccagctcgtagtaggcccacgccgagccgagcacgatgcccagcgtcaggaacacccacgccgccagcgtccacgggcgggcaaaacgggtgaacgcgctgtccagacgcccgctcagcagcgcggcgatggcgaaggcgaaggccaccgagaagccgacatagcccatgtacagcagcggcgggtggaaaatcagccccgggtcctgcagcagcgggttcaggtcgcgcccctccaccggaaaggccggcagcgtgcgggcgaacgggccggaggtgaacaggatgaacgccagaaaaccggcgcagaccatccccatcaccgccagcacccgggcgacgatatccgccggcacctgccggctgaacaccgccaccgccagggtccagccgctcatcagcagcacccacagcagcagcgagccctcgtgcgccccccaggtggcggccacccggtaccacaccggcagctgcgtgttcgagttgccggcgacataggccacggtgaagtcgttaaccacaaaggcgtgcaccagcacgaaaaacgcgcccgccacgcagataaacagcagccaggcgaacaccccggccgacgccatcatccgcgcgtcaccgcgcgccacgccccacagcgggtaaacggacagcagcagcgccacgccgagcgccaggcacagcagcgcgtggccgtattcaggcatcatgatgaggtgtccttatcagcgcgttgcgggcggcggtggttttcctgcatcgccttttccacttccggcggggtgtagttctcgtcatgtttggccagcacctcgtgcgccaggacgtggttgcccttctccagggtgccctgcaccaccaccccctgcccctcgcggaacaggtccggcagtatcccctcatagctcaccgtcaccgacccttcggcgtcgtagagactgaagttcaccttcagcgagtccgggtcgcgcctgacactgccgggcatcaccatcccgccgacgcgcaggcgctggcccgccgccggcagctgctgcgtctcgcgcttgccgtagaggatttcgccgggggtatagaacaggtcgatattcgcgcgcagcgcgtacaggaccagggcggtggtcagccccaggcccgccagcaccgcgcagaccacccatagccggtttttacgtcgcaggttcacgcggcctcctgttgcgcctgtgcggcacgcatccgcgcctcgcgcgcccgctgctgcgccacgccgcgcagaatggcccggcgctgcagcaccgtgtgcagcgccagcagcgccagcggcgccacggtcatcgccaccgccagccagacaaaaaaggcgtacccgcccatggcgaaaaaatcgctccacgatgaaaatgccggactcaccggtgcccccttttcagtatcagttcgctcacccacgggcggcgtttttccatcagtaaaatcaggttgcgcatccgcatcagcgaaagcgtcataaagagcagcaggtagccggcgatggcccagcgcagcggcgagcgcatcgccgggtcgatactctgctgcatccgcgtcgagccctggtgcagggtgttccaccactcgacggaatagtggataaccggcaggttcaccacgccgaccagcaccagaatgcccgccgcgcgcccggccattttacggtcgtcaaaggcgtgccacagggcgatgaccccggcgtagagaaacagcagcaccagctccgaggtcaggcgcgcgtcccacacccaccaggtgccccacatcggtttgccccacgccgcgccggtgaccagcgcgatgaaggtgtacaccgcccccaccggcgccatcgccgcgacggcaaggctggccattttcatctgccagaccagcccggtgaacgccgccaccgccatcgccgcatagatacccatcgaccagatggccgccgggacatgcaggtacataatgcggtagccctccccctgctggtagtccgccggggcgaaaccaaagccccggacccagcccgtggccagcacaatgatgccggccgccgccagccacggcacgagcctgccgcaaatctgatacagccggggcggcgccgccagctgatgaagggttttccacatagtcgtcacctgacctcctgaaaccagtaaaatgtccgtcgcgccggggcgctactgcacgctgaggcgcagcgccgccgcggtggcgaacgggcttaacgtcgcgctgcccgccagcagcgctcccagcaccgccagatagccgtcagcgggtaaatgcatcgatgccgcgtccatcgccgcggcggcgaaaatcagcaccgggacactcagcggcagcaccagaatgcccagcaggacgccgccgcgccgcagcccggccgtcagcgcaacgcccggcgcggcgagaaaccccagcgccggcgtgccgagcagcagcgtcagcgccatgattttccagccgtacacgtccatccccagcagcagcgccaccagcggggagagcataatcagcggcaggccggtcaccgcccagtgggccagcaccttcgccagcaccaccgccggcagcggcaccggcagcagcatcagctgctccaggctgccgtcctgcaggtcgtcgcgaaacagccgctccagcgccagcagcgaggccagcagcgccgccacctggatgatgcccggcgcgatacgcgccagcagctgcggctgcggcccgacgcttaacggaaacagggtgatgaccatcaggaagaaccacagcgggccggcgatgtccgcgccgtggcggaacgccacgcgcagttcgagacagaagacacgccacatcacagcccggcccccccgccggtcagcgccaggcggcggacggtgtccgcggcccccggcagcggctggtgggtggtgagaatgaccatcccgccctgcgccgtgtgcgccgccatccgccgggtgaggcgcgccacgccgttaacgtcaatggcggtgaacggttcgtcgagcacccacagcgcggcgcgggtcagccacaggcgggccagcgccacccggcgctgctgcccggccgagagctgagcgaccggcacgtcctcaaatcccgccagcccggcctgcgccagcgcctccgggagacgcgcgccgtcgccggggtggaagaagtgcaggttctcccgcgccgtcaggcgggttttgatccccggctggtgccctatccacagcagactgcgatggaagctgtcgcgcacgcggcgcaggggttcgccctgccagtacacctccccgccgtccgggcgcgccagcccggtcagcaggcgcagcagggtggtttttccggcgccgttgccgccggtgacctgcacccactccccggcgtccacggtgaacgacagcccgcgaaacagcgtcctctcgtcccgctcgcagtacagatctctggcttcaagcatcattgtcattgcgcatattcaggttgatatggcgtataaacaccggtcaggctttccaggaaggcgacgatatcgtcaatatcgttttgcggcagatcggtgccaacctgataacgcagcatcagttttaccgctccatccagcgtcggtacgtcgccccgatggaaataaggcgctgttaacgcgacgttgcgtaagcccgggactttttgccgtaatttatcgcgaacctctttggtgacgttcatacgaccaatatccgctgcggtaatttcgccaaaattaaagtctcgctttaatcccaatggttcaaaagagcgcccgcctaaaatgataccgccgtgacaggttgcacatttattctctttaaataattgataaccgtgtttctgttgcgcggtcagcgcattttcatctccacgtagccatttatcaaaggcggaatccggcgttatcaacgttttttcgaattcggcgatcgcatcagtaatattttccccggtaaatccttgcggataaaccgcctggaaatcttttttcaggacaggatctttatcaagcttgctaataatttcatcccaggatttagaggccatttcaataggatttaacggtggtcctcctgcttgctcctgcagggttgcagcacgaccatcccaaaattgttcgatattaaatacggagttgaataccgtcggcgcatttattggtcctaccgcaccgccaacgccaattgaggtttttctgccatcgacaccgcccgcatttaacgcgtgacaatgcgcacaggatattgtgctgtcgccggataaacgttcatcatgataaagccggaaacctaagtcgacttttttcgcatcgacgggaatattgcgcggaataggctgaacgggttcattccggtgcgccgggtcggtatcggcgctggcatagttgcgctcacgctgatcggctatccagttcaggatgtcagtacgctctttatcgctgacgccccccgcccagtgcagcgcgacatagcgggttggcggcatagtctgatgttgcataacccattcaattttattcagttcgctttgcggcaccggcgtatccgcaatcagggcggcccgtaccgcctccaggttaaacgacttgtagccgagctggatatcgtaatccattagctgctttgccaccggaaaagaggaataaaaaggcaattcagcggaaggcgtatgacaataatcacatcctttctccctgaaataacccagtattttattattttcacccacaaccgaggcctgcacatcgctttttttactgcgctgtttgtcgtaataccatacatacccggacaaacctaaataacataacagcccaacggtgataactgttgtcgcatagagggtaatttttttcatatcactatccttatggggtattgcggcatgattaattaaattttatttttttactcatgaggcccgtcaatactaaatacaaacccatcatggatattgattggtatcaataattacaattggctaaacctatagatatgataacccccgactatcgtaagatttattttgcgatgtccgtcacagggtttattcagcagcaacaatggataaatcctcttttccgtcatcaaaacgaacgatagccaacaataattgacttaacgcagcataaaagccatagggatcatgcttaaggcaattatttgtaaattccggaagccattccagtaatgacgacaatgttttctggcgtaatttattcattctccgttgttggaacgattcacccaatgaaaaatgtaaatggctgagtaattccagataaatcgccaggtggtcggtcggctctttaaaatcgtcgttgacttccatcccggcttcaagcaataaatgtttaatcatgccgggttcctgctgcgggtattgcgaggcgtagggcaaggccgattttttatccgtcatcaggaacaatccgcaaaaatctgcggccagctccagctgcgcatcctggcgcaggctaagcgcggcaattttttgttcgagtaacgccaccgacgccgccagcgcaggctgacgctttaacagcgccagccagtccgcgatctccgcggactgtaattgtattaacccttcatcatccacttcccggaaaaagagtaacgccagccatgcatatacgcaggcgtactgttcctgagcaagcgctggctgcttaatcatgcggattcccctgcgatgcgggtacatattcacactgcgcgaccatctcgaccggaccgttaaacgccgtgacgttatccatagggccggtatatttttcaatttccaccagcgtcgtatgcgcgctggtcgcctgcgcaagctgtgatgtaccgatatccagcgttaatacgttagggttgccgtacttacacaacgcgttgagatcgccgcctttatcaggatcgtaccaggcgccttcatgaattcgcgccacgcccggcgcatagcgatcggaaactaccgctcccgccagtacctgcccgcgtgcattgaatacccgcacgatgtcaccgttgcggatcccgcgcgcgctggcatcctgtgggttaataaagaccggctccttgccgccaacggcatattgctgacgcagcgtttccgactcgcacagttgggaatgcagacggaaatcagggtggacggattgtaagtgcagcggccagcgctgcgatcccggcccgccatgcgagcgttcgattttttcgaaccacatgggatggccctgacaatcgtcgtattgcatgtcggcgatggttttggagtaaatctcgatcaaaccgcttggcgtgcccaacggctccaggtccggatcttcacggaaagcctgatggcgtacaaacatctgcggatgatcaaactcgatgtactcctgttgattccagaacacctcgaaaatcggtaagtggataccgcgaccttttccctgctggctcccttcctgccagatgcgtttcagccagcccatttcatcaagaccttccgtgaatgccgcttcacggttaaagcgtcggcagagatcgcggaaaatatcaaagtcgttacgcgcttcaaactgcggcgacaccacctgtttcatggcgataatgccgcggttagagtggttgccgaactgatcgaggtcgttacgctcaaattgggtggtagccggcaaaacgatatccgcaaagcggcaggtcgacgtccactggttatcaatggcgatgaccgtttccagcttgcgccagccttcaattatgcggttaatttgttggtgtcggtggaacgggttggtcccggcgaacacgcacatcttcagcggcggtaatttaaccgatttgccgttccagttaatgatcttgcccggttcaagaatggcatccataaaacgcgcaataggaatggtgctgctgtagcctttgtaatccgtgctgtcgtgcactggcggaacggtcgtcgaaccggaaaagccgcttaaaatgatccctttacgaccaggcgtcccggcgccgttatagtgccagccaaaaccaaagccgccgcccggtaaaccaatctgtcccagcattgccgccagcacgacgaccatccatgaccactgttcgccatgctgcatacgttgtacgcaccagccagcgatgatttgcgttctgtcgcccgccatctgccgcgccaacgcgcggatggtgtcggcgtcaataccgcacagtttttccgcccaggcggcatctttgggctgtccatctttctcgcccagcaaataggggaggaactggtcaaaaccgacgcagtagttatcgaggaaatttttatcgtacagtttctcgctgtacagggtatgcgccagcgccagttgtaacgggacatccgtctgcgggttaatggcgatatgtttgaccttatcgcgccccagataatcgtgcgtggaggtgacgaccgggtcgatgctgatgaccgagatagcgccgctggcaaccttctcttttaattgttcatagtactgatagacatcgtgatccgggcaccaccagtttgcctgctggtttttcaccatatcagaaccccatagcacaatcgttttactgttctgtaaaaccagaggccatgacgtttgctgctcgtacacttccattgaacccaccacgcgcggcagaatcacctgcgccgcgccggtcgaatagtcccctcccgtgctaacgctattgccatgtagcgcaatcgcgcgcgccagcatcccggaggcgttatggaacatgccggtagattgccaaccgctcgccgtcagtagcgcgctcggcccgtaggttttttgcacccgctccagttcctgatagaacagatccagcgcttcatcccaggagacgcgcacaaaacgattatcgccgcgctgcgaggtgtcgctttgatgacctttgcgcatccagtcgacgcgcaccatcggatagcgaatacgcgccgcgttgtggacgtgatcgggcaggccggcgatcattttggacgggtatttatcctgttcaaacggttttgccgccacaaatcgaccgtcaaccaccgtggcgcgaatcgccccccagtgagaaccggtaaggataccctctttcgtcgcggcgcctggcgcaacggcatccgctgcgcgggcgctacggggcgtcagtagtgacggccccagcattcctgccaccgtcaagccgccaagctgcgccagaaaacgtcgacgagagacgtgtaacgagtccttatttttcattgtgttctcccttatcgctgtgcggcgtgttggtggtatcagacgcattcatctggagatatttcaacaaggtacgttcttcacgcttatccagactggtgaaaccgatcatgccgttgagcgtgccgatccagccgttagcgtcaaagtgcgctttgtccggcgcgccgtgacactgattacaggtgccgttatagagggagtcggcataggcccaaatcggtttaatgtcatttaccatgtcgcctttttgcatccacgcagttgcctgtaatttgctccactgagtattggtcgccgcgacggtggtctcttccagcgttttcacatgctgttgcacatcgccgcgaatcgaggcgacaaaaatacgtttaccgggcaactgcgtcagcacgcgctggcgaccgtccgtctccgtccagccttcgatttgcacttgcagccagtcaccgtcccgtttaaggactttcacttcagaagcaggtaacagcgaacctgccggttctttatcgcctttagcggcgtaaatcggcttgatatccagcgaatagagcgtatcgccgtcattatgcgtactggcgctggcgcgcagttcatcaaactgtttgcggaaaccgctgctcatatccggtagctggtgggcaatccctttatggcagtcgatgcaggattgattttctttcgcggcgattttcatttgccgcgccgcttccgggttctgtttcgcgtgatccatcgcatcgtagttatggcaggaacgacaggtcgcggagttattctctttcatgcgcgcccattcacgctcggcaagctcggcgcgtttggcttcaaatttttccggggtatcaatcgagtgggcgataaatgtctggtaaagatcgttgctggcttccagcttacgtttcaccatgcctggaatatcaggggggatatggcaatcgtggcattccgcgcgtacgccggaagcgttctggaaatgtacggactgtttatattcctgatacaccggctgcatactatggcagctgacgcaaaactctgtcgtactggtcagtttgataccgacgtgaggtaacacgatcagcgcaacgccgatcacaatcccgacaatgaccagcgccagtatcgaccaacgggcgcttggcctgagtagcgctctccagagttttcgcataatagcccctgtaattatatggtttaatgcgcagatcttattccgcaaatatgaacagcgtcactggtcaggatgaacgggatacggcaatatatgaacagatatgaacagaaagagaccgcgcgcaggatgtcacatcacattgttattgttgaggatgaacctgttactcaggccagattacaggcctattttgagcaggaggggtatcgcgtttcggtgaccgacagcggcgcgggcctgcgtgacatcatggagcatgagcacgtttcgctgatcctgctggatatcaacctccccgatgaaaacgggttgatgctgaccagggcgctacgcgaacgttccacggtgggcattattctggtgacggggcgttgcgaccaaatcgaccgcatcgtcgggctggagatgggcgcggacgactacgtcaccaagccgctggaactgcgcgagctggtagtgcgggtaaaaaatcttttgtggcgtatcgatctggcccgccccacgccgcaaaatgccagtgaaaactgctatatgttttccggctactgcctgaacgtgatgaatcacacgctggagcacaacggtgaagccattaagcttacgcgcgcggagtacgagctactgctggcctttgtgaccaacccaggcaaagtgctgcatcgcgaacgtctgctgcgaatgctttccgcccgccgcgtagagactccggatctccgcacgattgatgtcctggttcgccgcttacgtcataaaattacgccggaactgctggtcacacagcatggcgaaggctactttttagcctcggaggtgtattgatacagatagacgggccgaaatcccggaggcgatagcgaacggcgaacgcgcgcgctgtcggcgttgttatgcgtcaaaataagcaccggcgggctgatattttcaggcaccggttgcccctgtaagaccttaatcgactgcgttatcgctaattctccctgccaggccatctgatcgctgagcgccatcaggatatggccgcgttttaaaccgcgataaacctgatgcgtcagataaaatgagacgatcgtgagcggagtcgtcaaattacgcccttcgcccatcgccgcctccgccgctatcgccgacccggcgaccacattggcgtccggatggcgttccagcatttcctggagtaagtttcgctgcacttcaatgtcgttatcgccccaggcgatatccacaatgttgatggcgctgcctttaattgcctgacgaaaacccgccaccatctcctgactgccgccggcttcttccggccccgggaagagtaaaacgttaagcgcttttcctttgctccactgcaccaggaaacgtcccggcagataacccatctgaaaccacggcagaccgacgtgagttgccacgctggcgtcgcgtatcacgttcgccacttcaataaccggcacattaccggcataccgttccagttccgggaaacgaatggtactgctgccaagcagaatagcgtcggcgccccactcccggcactgcatcatttgctgttgttgcgtcgccagttgccgatagccattcgcttccagcacttttaaatcaacgccatacaatttggccgctttttgcatcccgtagttgacggacaaccagtaagaatctttcaggctggggtataatgcgcacagtttccagggtttactcgcattgactgacgtttgccgccagggaatcgcccgatcggcgcgcgtccagtgtagcagtccggtttcggctgacgccgtttctatattcgagacgatgattatcaaaaaaaagaacgaaataagcgcgcgcatgatagccccaccagcaacaaggttttatcctaatggtttttccggcggcaactcaacccatttcacccgcggcgcataaatgtcaacgccttcactgacccgcagattatggctggccttcgccctgatggcggcgctcaccctgctcagcaccgtgatcggctggataagcctgcgcgtcattagtcaggtggagcaaaccaatacgcaagcgctgctccccacgatgaatatggccaggcagttaagcgaagccagcgcttacgagctcttttccgcgcaaaatctgaccaatgccgacagtgagggcgtttggctggcgcaggggaagatgctgaaagcgcaaagccttaaaattaaccatcttttgcaggcattaagcgagcaggggtttaatacctcggccatcgcccggcaagaaaaagagattgcacaaacgcttgggcaacagggaacgctggtcggtgaaattctcacgctgcgcgcacagcaacagcagttaagccgccagattgcggaggcggcggaaagcattgccgcccaggctcacggtcaggccaataatgcagcgacatctgcaggcgccacccaggccggtatttacgatcttatcgaaagcggtaaaggggatcaggctgaacgcgcgcttgaccgactgattgatatcgaccttgagtatgtgaatcagatgaatgagttgcgggtcaatgccctgcggtttaagcagctcattgtgaccttaaaagacgcgcaagggctgagcgatgccgaagacaccgatgaaaaacttaatcagttggttaaaattttatcccgccgccagcagcgtatagaagatcctaccgttcgcgcccaaatcgccgacgcgctggagacaataaaccagtacaccacactggttaccctgtttcgtaaggaaaacgccatccgcgaccagcttcaaacgcttatggccaataacctctttcagtttacccgcttcagtacggaagtgtcgcagttggtgaacgccatcgaaaaacgaaacgaggctgggttagcgcgtcttacacacgccagtcagcgtgggcaaatagggttagtgatcttaggcatcctggcgctgtgctcattaagttttattctttggcgagtggtttaccgctccgtatcccgcccgctggcgcaacaaacgcaggccttacagcggctactggagggcgatattgactcgccatttccggaggcggctggcgtcagcgaactggataccatcagccgtctgatggaagcgtttcgcgccaacgtgcgcaaattgaaccgccatcgtgaggatttggcggaacaggtgcgatcgcaaacggcggaacttcatgcgctggtgctggaacaccggcaggcgcgcgccgaagcggaaaaggccaacgaggcgaaatcgacgttccttgccgccatgagccatgaaattcgcacgccgctttacggcattctcggtacggtacaattgctggccgataaaccgctcatgacaaactaccgcgacgatttacaggccattaatgattcaggcgaatcgctactggcgattcttaacgatattcttgattactcggcgattgaagtaggcggcaccaacgtttccattagcgaggaaccgtttgaaccgcgacaattgttgaatagcgcgctgcatttaatgcacagccgcgttcaggtggcgctcatcaccgactttagcgagcaactcccctcaacgctacaaggcgatccgcgccggatacgtcaaattgtgattaatcttttaagtaatgcggcgaaatttaccgatcgcggcagcatagtgctgcgcacgttttgcgacgatcagagctggtttattgaggttgaagataccggatgcggtattcctgaagcgaagctgacggctattttcaaaccgtttgtgcaggcgacaggacgccggggcgggacgggcctggggctggctatcagcgccagcctggcagaggcgatgggcgggacgctaaccgtcaccagtacgcttcatgttggcagttgttttcgtttacaactgccggtttgccactccaaacccgcaagtaaaagtgcgttcagggaaccgataaatcttaacggactacgcttgttgctgattgaagataatatgctgacgcagcgtattaccgctgaaatgctcacgggcaaaggggtgaaggtctcacttgctgaaagcgcgaatgacgcgctacgctgtttagccgaaggcgagtcctttgatgtcgcgctggtggattttgatttgccggattatgacggcttaaccctggcgcagcagttgatgagcctgtatcccgccatgaaacgcattggttttagcgcacatgtgatagacgataatcttcgtcagcgtaccgccggtcttttctgcgggattattcaaaagcccgttccccgcgaagagctttaccgcatgatagcgcactatttacagggcaaatctcacaacgcgcgggcgatgttgaatgaacatcagcttgccggcgatatggcgtctgtcggcccggaaaaactccggcaatgggtcgcgttattcaaagacagcgcgctgcctttagtcgaggagatcgaggcggcgcgcgccatgaatgacgacgttaacattaagcggctggcgcataaattaaaaagcggctgcgccagcctggggatgacgcaggcaaccgaagcctgtcgggaactggagttgcaaccgcttagcgatatagatattaaaactatcgtgacgcagggagtgacggcgctcgacgcatggatagccggtcatccttcgccataatgacttccggctcgccacggccaacttatccgacgcgtttcacatcgcccactaacaggatgtaagacagcgcgcccagcagggccacaacggagatatagaccagcgccggagcaaaaccgtagctttgcgccagataaccaatcactaacggtacgctaatcccgcctaacccaccgataaagttaaacataccgccggtaaggccaatcaaccgcatcggcgcaagggaagagattaacgaccaggtaatggacgcaaatccgttgccgaagaaagctatcgccatcaacgccataatccacaacggatcgttagtgtagttagcgcccataatgcatgtggagatgagcaaaccgcaaataatcggcgttttgcgcgccacgcccagcgagaagccttttttcaccagtttatccgccagccagccggagagcagtacgccaaaaaaggcagccaggaacggtacggtcgtcataaagcccgcttttagcgcggtaatgcctttttcctgggtcagataattagggaaccaggtcagaaagaaccatagcgtagagtttacggcgaactgaccgaggtagacgcccaccagcttacgatggaacaccagtttccagtcggctttcgtcagcggctggcgggcctcttttttcgctggcgcatcgccatccaccagaccaccgccatcgcgaatatactccaactccgcctggctaaggcttttcgtcaaacgcggcggttgataaaccttaaaccagaccaatgaccagataatcccgataccgccggtgacgataaagacccagtgccagctcagcatttcctgaatccagatcagcagcggcgtaaggaatgccagtccgacgaactgtccggaggtgtagaacccgactgcggatgcgcgctcatgctccggaaaccagctagtgaccatccggttatttgccggaaaggccggcgcctcgaaaatcccggtaatagcgcgcaggccgataagcgacaatagtcccgtcgcaaacccctgcaatagcgttgcgactgaccagccgaagatagcgataaaataggtcagccgggacccaatacggtcgagaaaccagccgccggggatctggcataacgtatagagccaggcaaaagcggagaagacatagcccatttccgctttggtaatgccgaattctttttgaatatgcatggaagctacggcaaggttggcgcgatcgacgtagcaaatcaccacggtaataaagatcatcaccagcgtcagatagcggcgacgccccggctgtgctgctgtaactgaaatatccatcgtcatctgtctccagattctgggcatagcgaggccgctcaccatgccctgtaaattacagagggtgtgtttttatatttaaattgggttgcccggagggcgacgtttgttgagcctacagcgtggcgatcaccactcggctaccgatccgtcagcgtgccgccacaacggattacgccagtccggcgcgcttttgctaagttcaatcaccctggcctcgtcaatgtctacgccaagacccggtttggttaagggtttaaagaagccgccgtccatgctgaagtcttctttatttttcacaaagtcgagcagctccgcgcccttgttatagtgaatgcccatactctgttcctggaataccgcgttgcgcgaaacaaaatcgatatgcaggcaggcagccagggcgattggacccagcgggcaatgcggcgccagcgccacatcatatgcttccgccattccggcgattttatagcattcggtaatgccgcccgcgtgggataaatccggctgtagaatcgccagcccacccgcgtccagcacgcgtttaaattcaaaacgcgagaacatacgttcgcctgcggcaatcggaatatgcgtttgcgctgccaggcgcggataatattccgcctgttccgccagcaccggctcttcaataaacagcggacgatagggttccagttctttaatcagcaccttcgccatcggcgcgctaacgcgaccgtggaaatcgagcccaaactcaatttcactgccgaaagcttcgcggatttgcgccacggtattgaccgccgcatccaccgcacgggagttatcaatcacgcccatctcttcacagccgttcagcttgaaggtgtcaaaaccaataccgcgcaatttttcaataccgtcaatgacgtctgccggacgatcgccgcccacccagctataggccttgattttgtcgcgcaccaggccgcccatgagctgccagaccggcgcattcaacaccttgcctttgatatcccacaatgcctggtcaataccggcgatggcgctcatcataatcgggccgccgcgataaaaaccggcccggtacattacctgccacaggtcgttgatacgcgccggatctttccctatcaggtagtcggcaaactcatgtactgccgcctctacagtacgtgcccgaccttcaatgaccggctctccccagccaaccacgccttcatccgtttcgattttcaggaacatccaacgtggaggtaaacggtacgtggtgatgtgagttattttcatttcactgcctctcgatacgcattaacaaatgccgcagcctgctgcgcggtgcgttcaacggattgcccggcgcgatagagatcgctacccaatcccgcgcccacacagcctgctttaatccattgcgctaggttttccggcgtcacgccgccgacggcaaatagcggaacatccggcggaagtaccgctttcagcgcgctgatgtagcccggaccaaacgccgacgacgggaaaatttttaacgcctgtgcgcctgcatccagcgcagaaaaggcttccgttgccgtggcgcagcccggacacacggtcatgccatagctcaccgcccggcggatcacctccggttggatattcggcgtgacgatcagcttgcagcccatcccggcaagctggtctacctgttccggtttcagtacggtaccagcgccaataagcgccctgccgccatacgccttcaccacggaagaaatgcttttttcccactgtggggagttaagcggaatttctatagcgtcaaatcccgcatccaccaccgcgccaacgtgcgccagggcatcatcgggcgtaataccgcgtaagatagcgatgagagggagattagtttgccactgcatgagcgatgctccttattccagcctgaaatgccatatcgccatccacggttgaaacatcacgcccaatagcactaaacgcctgttggtaacgtgagatcagcgcgggtccagcgacgagagtgatagcctgttgcgccgcgaaggattcgctcatgctggcgacttccgcgccaatcaacaggccggagaggaagtcgctgacctgctcacgcgcaagatgtcccaacacgtgcgaggcgcgaacctcaaaaagagaaggcaggacggcaggagaattaagaccgcgctccagccccgcggcataggcgtcgccagaaacttcctgttccggcaaaccagccccgaccagcgagtgacgcagcaacaagtgatggagttcgcctgtcatcacagtacgaaaatcatgaatttgttgcgtatcagtctgtacccatttgcaatgtgtgccgggcatgacatagacagaagaaggagaaagttcgcaggcgccaagcagttgcgtctcttcgccgcgcatcacgttgtggttatcctcgcgtgagacacacaatccggggatgatccagatgttgtcgccaacggcggttaactgttcgccaatagcggagaacagggcgggaaccggcagataaggcgcattttgccagcctacgttactgccgatcatgcccgccattaccacgggggtggcgctgtcgcgccagtgtgttgtgacttctgctaacaccgcgtcaggagatttaccgttcaggcgtgtaacgcctgcttctgattgcctgctctccaggcatttgtcgccctggtaaagccaggcgcgcagattggtcgatccccagtcaattgcgatgtagcgagctgtcatgtgatttcctttaaccttcgtgtcgagctggcgatcatggttaatgccgcctgctctgccgcatcgccatcctgatgccgtatcgcatcgaatagcgccttatgttcctggagcgttttcggcatgttggccgcatcgcccatccaggtccgttcaaataccgctcgctgtagcgagctgatcgctacatttaactgttgcagcaccgggttatgcaccgactgcaacactgcttcgtgatagcgaatatccgcctcgttaaacgcttcccggtcctggttattggcaatcatgtcgtttagcgccgactcaatttcagccagatcgcttgatgttgcccgttccgccgcccagcgtgctattgctggctccaccaggtttcgtatttcgctcatcgcgctgataagcctcgggtcgtagtcgttttccagcacccattgcagcacgtcggtatcgagataattccactggttacgcggtgcgataaacgcgccgcgataacgcttcatttcaattagccgcttcgccataagcgagcgaaacacttcgcgaatgatgttgcgcgacgtttcaaactcctcgcacagatccgcttccgctggcagcgccgaaccgggtacgtatttaccgctgacaatctgtttgcccagcgtgataacgatgcgatcggttttattgagagtcatagagagtccttgtgctcgatgtgaactctcttactttaccgcgatagctgaattacgccgcaattttgtagtactagcgtgatatcaaccgtcgttatcatgccattaatgtagtacaacacaattatgttgtactacaatttagatcacaaaaacgacaattggttatgggaacgttataagacgtaaacgaaagacataaaaaaacccgcagcaagtgcgggtcgttaagcgagtatttgcccgatggcgactatgccttatcgggcggggaaatggccggatgagtgatcggggttcagcacaaatttttcaatcgcccaggcaacaccatcttcaaggttcgatttagtcacaaagttagccacctctttgaccgacggaatggcgttgtccattgccacgcccataccggcgtattcgatcatcgcaatgtcgttttcctgatcgccaatcgccatcacctcctctggcttaatacccagcgcctcgaccagtgattttacgccagtgcctttattaacccgtttatcgaggatttcaaggaaatacggcgcacttttcagcacggtgtacttttccttcacctctgccggtatacgcgcaatcgcccggtcgagaacggcaggctcatcgatcatcataactttcaggaactgggtgttcgggtccatcttctccgcttcacaaaataccagcggaatggtcgccacatacgattcatgcaccgtgtagtagctgatatcgcggttagcggtataaagcgtatttcggtctaatgcgtggaagtgagaacccacctcacgggacagtttttccaggtaacggtagtcatcatagctgagcgccgtttgcgcaaccgtactgccgtcccctgctttctgcaccagcgccccgttataggtgatgcaataatcaccgggctgttccatgtgaagttctttcaggtaactgtgcacacccgcatacggacggcctgtggtcagcaccacgtttacccctttttcacgcgcagcggcaatcgcgtttttaaccgccggagaaatggtgtgatcgggcagcagaagggtgccatccatgtcgatagcaatgagtttaatagccatgaaatccccgcattaaatgagtcctgactcatgctaacgcgattccgctcaaaaaacagtaaagaatccgagagaaagggggataagattcacaaacgggattccccttttcaggccgtattctctcctcctgatgtattagataacctcattaatcaaacagaaaataccgtttttctaaaagaatgcgtattgctactttggacatcatcacttagagcctaatgggattggttcttaatcagtaaaaatcaacaaaaacttatattttaaaataaccttatccgatgagaaggagatcgctaatgtcgatggcccttaccgcccccccaaccaggaaaagatttttaatcgttgcctgtctgtttattggaatatttattgcttatctcgatcgcgttaatgtttcggtattagccgcgaatgaacccttcttagcctatatgggtattgaaggcatgcccttgcaaatcggcatgatgatgaccgtctttctggccgcttatggtatcgctaacgttgtattatcaccgcttggtgattatctcggccccagaaaagcgatgatgctttgtattctgatctggactatcgctttaatgattggcggagtcgctacatcattcgctctaattattatttgccgtatattactgggcatcggagagggattttattatccactgcaaagcgtatttattaaaaactggttcccgaagcaggaacgcggcagagcaaacgcggcgtggatcgtcggccagtcagtcgctcccgccattgcgatgccttttttcacctggtggataggcacccacggctggcgctccaacttctttttatgcgccgctcttgggttaatcccactctggctactttggcgatatgttgctgataaaccagaacaacataaaagtatcagcgagcaggaactggcttatatcaaagccgggcaggaaacggaaagcgcaggcagcagcgaaagttttatgttgcgggtcaaaccggtgattaccaactacagctattggctgctggtgctgtggtatctgtgtctgcaatgtttatattggggaatgattacctggctgccgacctatctaaaatcagccagagggttcagttgggcggaaatgggctggctggcgtcgcttccctttgtcctgtcgatatttgccaaagcggccgcaggcgtcttcgtcgataaaataggacgcagcgcccccatattaatggtattaatgtttttcgctggcgtcagtatctatttcggcaccataaccgaacataaatatatgtcggcggtactcctctcctttgctgttgctttctgtacgatgggtacgcccgttgcctggacgttattacagggaatgataccaggaaaatccatatccgccgccagcggcgtaatgaacggcgtcgccaacggactctcttcattatctcctgtatttatcggcttatttatttctatcactggaacttataccggcggcttactatgcctggtttttatcagcgctatcgccgtggtatcggcattaatcttaacgattaaaaaatattaattacgaggagtaaatgatgaaaattaccagcgttgatattattgatgtggcgaacgattttgcgtccgccaccagcaaatggcgtccggtggtggtaaaaattaataccgatgagggcatttccggttttggcgaagttgggctggcttacggcgtcggcgcttctgcgggcatcggaatggcgaaggacctgtcggccattatcatcggcatggacccgatgaataacgaagctatctgggaaaaaatgctcaaaaaaaccttctgggggcagggcggcggcggcatcttttccgctgcgatgagcggcatcgatatcgcgctgtgggatatcaaaggcaaagcgtggggcgtgccgctgtataaaatgcttggcggcaaaagtcgcgagaaaataagaacctacgccagtcagctacagtttggttggggggacggcagcgataaagatatgctgaccgagccggagcagtatgcacaggcggcgctgaccgccgtcagcgaaggctatgacgcaataaaagtggataccgtcgcaatggatcgccacggcaactggaaccagcaaaacctcaacgggcctctcaccgataaaatcctgcgtctgggctacgaccgtatggccgccattcgcgatgcagtcggcccggacgtggatatcatcgccgaaatgcatgcctttacggataccacctcggcgattcagtttggccgcatgatcgaagaactgggcatcttctactacgaagagccggtcatgccgttgaaccccgcgcagatgaagcaggttgccgataaggtcaatattccgctggcggctggcgaacgcatttactggcgctggggataccgtcctttcctggaaaacggcagcctgagcgtgatccagcccgatatttgtacctgcggcggcatcaccgaagtgaagaaaatctgcgatatggcgcatgtttatgacaaaacggtgcaaatccacgtttgcggcgggccgatttccacagcggtggcgctgcatatggaaaccgcaatccctaacttcgtcatccacgaactgcaccggtatgcgctgctggagccgaatacacagacctgtaaatacaactacctgccgaagaacggcatgtacgaagtcccggagcttcccggcatcggccaggaactgaccgaagaaaccatgaaaaaatcaccaaccatcaccgtaaaataagccaactgtctgcctgcgccgcaggcagacaccctgtatttgcgagtcgtatcaacgcgaccttatccagcctgagataaaatcctctcagtaaaggggtaacacaggtggcaaatgaatttaactatccggcaatttcgcgcgtttctggccgtcgcggatttgcgtagttttaccgccgccagcaaatatctgtgcatcacgcagggagctgttagcggtttaatcaacgaaatggaaagccagatggaggtttcccttttcgaccgcacttcgcgcgtggtgaagctatcgcccgacggcgaaaagtttttacccgccgccatgcgggttgttgaagagtttcaacgggccgaaaattatgcccgcgacctgaaagagatcaaaaaatccctggtgcgggttgttggcgcgccgctgatcgcctgtgcttttctgccgcaaatcatccatgcctttaagcggcagcatccgcatacccacgtacagcttattgataagcccatgtcgcaattacaaaaaagcattatgttgggagaagccgattttggtatcggcccggagcggccgctggaaccggaaatcgacaaacaaacgctgttcacaacggaaatcgccctgtactgccatccggactatcggctgcataaaaaaacggttcgctgggaagagattcaaagcgaagagctgatcgccgttggcaacgaatccattccgatgatctccgcaaccgctggcgtgcgcattaagcccaaaatgacggtggaacatatggcgaccgccatgtcgctggcggcgcagtgtgaaggcgtggtgatcgccggaaccttttcccgccattacgccaaaagctaccaattagcgacctgttcgctcacgcctccgctgcggcgcaatatgaacctttatttccatgcgtggcgcgcacaaacgcccgccactcagcgctttagagattttttattcagctatgtcgatgaacatcatgatgccccggccaaccagcggtaggccggggattaaggcaggttaaatatcgatattcgctgctttcagggcgttctcctcgataaaggcacgacgcggctcaacggcatcacccatcagcgtagtgaacagctggtcggcagcaattgcatctttgacggtcacgcgcagcatacggcggctttccgggtccatggtggtttcccacagctgatccgggttcatttcacccagacctttataacgctggatagccagaccgcgacgtgattctttcaccagccactccagcgcctgctcgaagctggttaccggctggcgacgctcgccgcgttcgataaacgcgtcctcttcaatcagaccacgcagcttctcgcccagcgtgcagatacgacgatattccgcgccggtcacaaactcgtgatccaacggataatcggtatccacgccatgcgtacgcacgcgaacgatcggctcgaacagattctgttccgtattagtatgaacatcgaacttccactgactgccgtgctgctctttctcgttcagctcggtaatcagcgcattcacccagcgcgttacagtctgctcatcagaaagatcggcttcggtcagagttggctgatacaccagctctttgagcagcgctttcgggaagcgacgctccatacgaccaatcattttctgcgtggcgttatattcagagaccagtttttctaacgcttcgccggatagcgccggcgcatgagcgttcgcgtgcagagtcgcaccgtcaagcgcgatggaaatctggtactgatccatcgcttcgtcgtctttaatgtactgttcctgcttacctttcttcactttgtacagcggcggctgcgcaatgtagacgtggccacgctcgacaatttccggcatctgacgatagaagaaggtcaacagcagcgtacggatgtgcgagccgtcgacgtccgcatcggtcatgatgatgatgctgtgatagcgcagcttgtccgggttgtactcgtcgcgaccgataccgcagcccagcgcggtgatcagcgtcgccacttcctgggaggaaagcatcttgtcgaagcgcgctttctcgacgttaaggattttacctttcagcggcagaatcgcctggttcttgcggttacgcccctgcttcgcagagccgcccgcggagtccccttccaccaggtacagttcggacagcgccgggtcgcgttcctgacagtccgccagtttgcccggcagaccggctaaatcgagcgcgcctttacgacgggtcatttcacgggcgcgacgcgccgcttcacgcgcacgcgcggcgtcgataattttgccgacgacgattttcgcgtcagatgggttttccagcaggtattcgctcagcagttcgttcatctgctgttctaccgccgatttcacctcggaagagaccagcttatctttggtctgtgaggagaatttcggatccggtacttttacggaaaccaccgcaatcagaccttcacgggcatcgtcgccggtggcgctgactttggcttttttgctgtagccttctttgtccatgtaggcgttcagcgtacgggtcatcgccgcacggaagcctgcaaggtgagtaccgccgtcgcgctgcggaatgttgttggtaaagcagtagatgttttcctggaaaccatcgttccactgcagcgctacttccacgccgataccgtctttttcggtggagaaatagaagatattcgggtggatcggcgttttattcttgttcagatattcaacaaacgccttgatgccgccttcgtagtggaaatgatcttctttgccatcgcgcttgtcgcgcaggcggatggagacgcctgagttcaggaatgacagttcacgcaggcgtttcgccaggatctcatattcaaattcagtgacgttggtgaaggtttcgtggctcggccagaaacgtaccatcgtgccggttttatcggtatcgccagtgacggccaggggtgcctgcggcacgccgtgctcgtagatctgacggtgaattttgccatctcgctggataaccagttccagtttttgcgacagagcgttgactaccgagacgcccacgccgtgcagaccgccggagactttataggagttatcgtcaaatttaccgcccgcgtgcagaacggtcatgatcacttccgccgccgagacgccttcttccgggtgaatcccggtcggaatgccacggccatcatccgttacggacacggagttatcggcgtgaatagtcacgacgatatctttacagtgacctgcgagcgcttcgtcgatagcgttatctaccacctcgaataccatgtggtgcagaccggtgccgtcatccgtgtcgccgatatacatacccgggcgcttacgcaccgcatccagccctttcaggactttgatactggaggagtcataagaattcgacatcaacgtttctcgctcatttaatcttgggttaatccgttattttacccttttccacggtaaacatcttcgaattttcatccgacatgtctataacgtgttcagcgctaattgcgctgacaaagacctgcgattgcgtggcttttaagcggctggccagcagtccgcgacgcgcatcgtcaagttcagaggcaaaatcatctatcaggtacaggcagcgccgcccgctttcgcgggtgaggaactcgccctgcgccagacgtaaggcgcacatcaataactttagctgcccgcgcgacagggtatcttccaccggcgcgccgtcggcgcgaatgcgaaagtccgctttatgcggcccgtgcgcggtgtaggtcaacatacggtcacgctcaaagcttcgctccagcacgtccgcatagtctgtctctttctcccagccgcgctggaaagagaacgtcagggaaaattcaggtaaaaactgctgacaggtatccgccatgtcctgtgcgatagcgctactgtactccgcccgccaggtactaatttgttccgccagcggaatcagctctttatcccacgggcgcaattgctcataacgactcacctggcgcagcgcggcattacgctgtttcagcaatcgtttcaggttgctccaggcggtgaagaatccggcttcgttgtgaaagcatccccagtcaaggaacgctcttctgtatttggggccgccgttgagtaaagtaaacccctccggcgtaatcaactgcatcggcattaaatgcgccagctccgcgatcttgtgaccgtcggtaccgtcgatacggaccttgctgtcgccctgcttatctttggttaagccaatcgacgtctcacgctcttcgctctgtaatcgcccgtgaagaacaaacgcttcctgctcatgacgaatcacgcggccaggctgcaaactgcgaaacgcccgaccatggccaagcgtatagatagcttccagcacgctggttttgccgctgccgttggcgccaaccaggaagttaaagccgggggataaagcgagatccgcattttctatgttgcggaagtctttgattaaaaggcgcgtcagtgacatatattagtacattcgtccaggggcgtgtgtgtcgcagccagttcgtctaccgccagcgcgcagaaagcggagcgtacacgaagtacgtgagcatttcgagcactgccgggaggcgaaatggcaagtaaaccagccccttttcagattctacagcctcattggcataacaacgtaggcagcactctgtgacgccgcatcctcaatctgtacgctggatacggaatccgtcagcataatgcgcacggtttcgcacttcagcgcattgagcacgtccagcacgtaactgacgttaaagccgatttccatctccgtcccgccgtagctcacgtccagaatctcttccgcttcttcctgttccgggttattggcggtgattttgagctgattctcactgacgtacagacgcacgccgcggaatttctcattcgagaggattgctgcgcgggcaaacgcctgcttgaggatatcgcagcccgcttccagatgtttatccggattcttcggcagaacgcgacggtaatccgggaagcgaccatccaccagcttcgaggtaaagataaagtcgccgacgtgcgcgcggatattattactgccaatctgcacgcgcagcgggttttcgccgccgtcgagcatacgcatcagttcaatcacgcctttacgcggcacaatcaccgagtggctgggtaaagacgcttccagcggcattgagcacaccgccagacggtggccgtcggtcgcgacagtgcgcagttcgctaccttccgtttcaaacagcataccgtttaagtagtagcgcacatcctgatgggccatcgaaaactgggtcgattcaatcaggcgcttcatcgtggcctgcggcagcgtaaattcaacttcgctttgccagtcgtcaagattcgggaaatcggcggcaggcagcgtagacagcgagaagcggctacggccagaacgcaccagcatccgatcgccttccaactgaacggcaatctccgcgccctccggcaggccgcggcagatatcaaagaatttccgcgccggcacggtagtggcgcctggctcatgcggctgagaaagcgtaacgcgcgcgaccatctccatttcaagatcggtgccggtcagagaaagcgtaccgtccgctacctggaggagcaggttaccgagaatcggcagcgtaggacggccgcccagcgggccgctgacctgctgaagcggttttaataaatgttcacgttcaacggtaaatttcataggatcacgacgacaatgttctgattaaattcgaaaaatcttctttgatatcgtggctttcttcacgcagttgctcaattttacgacaggcatgaagtacggtagtgtggtcgcgcccgccaaacgcatcgccgatttccggcagactgtggttggtgagctcttttgccagcgccatagccatctggcgcggacgtgctaccgagcgagatcgacgcttagaaagcagatccgcaattttgattttgtaatactcggccaccgtcttctgaatattgtcgatggtgaccagtttttcctgcaacgccagtaaatcgcgcagcgcttcgcgcacaaagtcgatagtaatcgcccggccggtaaagttggcattggcaatcacccggttcaacgcgccttccagttcacgcacgttagagcgtagacgtttggcgataaagaacgctacttcgcctggcagacgaatatcattttcgtccgcttttttcatcaggatcgccacgcgggtttccagttctggcggttcgatcgccactgtcagcccccaaccaaagcgggacttgagacgatcctcaacgccgttgatctctttcggatagcgatccgacgtcaaaatgatctgctgattgccttccagcagagcgttaaaggtatggaaaaactcttcctgggatcgttctttattggcgaagaattgaatatcgtcgatcagcaatgcgtcaacggagcggtagtagcgtttaaactcttcgatggcgttattttgcagggcttttaccatgtcctgcacaaagcgctcggagtgcatatacacgactttcgcgttgggtttacgcgccataatgccgttacccaccgcgtgcagcaggtgagttttacccagaccggtgccgccatagaggaataacgggttataagcgccgccaggattatccgccacctgacgtgccgccgcgcgcgccagttggttggatttaccttcgacgaagttatcaaatgtatgttttacattgacgttggagcggtaggtcggctccgctggcgctggtacgttatcccagcccgaacgggccgcaggcgctacgcgctgcggctgcgccgttgttgtctgcgcaggcgcgacaacgttatgcacaggcgtttttagcgtttgcgtaacgggctttgttcccacttcaaaacgcagttgtggggcatccgcgccgcagaatgtgttgagtaatccattgatattgttgaggtacttatctcttacccaatcgagcacaaaacggtttggcgcatacaaagccagcgtgttatcgctcagttccgcctgcaacgggcgtatccacatactgaattctgtggctggtaactcatcctgcaatcgggcaagacactgctgccaaagcgaaagtgacacggcggactccactcgaacaaaagtcgataaatgacaaaggctgatacattaatgattgttggcgcacgtcgataagaccctgcatgaagggtgacgcacgaaccgctgtctgcggttttcacggatctttcaaacgatcgcgacttcacgcagtctgaaaaatttcgtgttcatgcctgaccaggatcgtttgaaacgatcaggaccgcggatcatagcctaaactgagcaagagatcttctgtttctcacagattcttccctatttatccacaggactttccaggaaaggataagtgtaatcgatcctggggaactcctgtacgctttcgcgcgcatattgaaaaaattaataggtaaaggtgagcagacgcctaaaagatcgcataaagatccagggcgatccttgcgctttacctggcagtccgtataattctccacccgtcgcgcaatgcccgtcatatggcgtcaacgctgcttattttccgcacaaaaaggcgtggaaaatcgcgggaaaataaggaaagagaattgactccggagtgtacaattattacaatccggcctctttaatcacccacactgtggcgtaagtcgttcaaagtttgttcgggtatacgcaaaagtcagtgaatttattcaagtttaggtagaaatcgccatgaaacgcacttttcaaccgtctgtactgaagcgcaaccgttctcacggcttccgtgctcgtatggctactaaaaatggtcgtcaggttctggcacgtcgtcgtgctaaaggccgcgctcgtctgaccgtttccaagtaataaagctaacccctgagtggttaagctcgcatttcccagggagttacgtttgttaactcccgctcatttcacattcgtcttccagcaacctcaacgggctggcacgccgcaaatcaccatcctcggccgcctgaattcgctggggcatccccgtatcggtcttaccgtcgccaagaaaaacgttcgacgtgcgcatgaacgcaaccggattaaacgtctgacgcgtgaaagcttccgtctgcgccagcatgaacttcctgcaatggatttcgtggtggtggcgaaaaaaggggttgccgacctcgataaccgtgctctctcggaagcgttggaaaaattatggcgccgccactgtcgcctggctcgcgggtcctgatagcccttattcgggtctatcaacgcctgatcagtccgctgcttgggccgcattgtcgtttcacgccaacgtgctcaagctacggaattgaggcattgcgcaggtttggagtgataaaaggcagttggttgacggtgaaacgcgtattaaaatgccaccctttacaccctggtggtgacgatcccgtcccgcccggaccatttgataccagagaacactaacgatggattcgcaacgcaatcttttagtcatcgctttgctgttcgtgtctttcatgatctggcaagcctgggagcaggataaaaatccgcaacctcagactcaacagaccacgcagacaacgaccaccgcagcgggtagcgccgccgaccagggcgtaccagccagtggccaggggaaaatgattacggtgaaaaccgatgtgcttgatttgactatcaacacccgtggtggtgatgtcgagcaggccttgctcccggcttacccgaaagaactgggttccaacgaaccgttccagctgctggaaaccaccccgcagtttatctatcaggcgcaaagcggcctgacaggccgcgacggcccggataacccggcgaacggcccgcgtccgctgtacaacgtcgagaaagaggcgtttgtactggccgacggtcagaacgaactgcaggttccgatgacttatactgacgccgcaggcaacacgtttaccaaaacgtttgtctttaagcgtggcgattatgcggttaacgtgaactatagcgtgcagaacgccggcgaaaaaccgctggaagtctccacctttggtcagttaaaacaatccgtcaacctgcctcctcatcgcgacaccggcagcagcaactttgcgctgcatacattccgcggcgcagcgtactccacgccggatgagaagtatgagaaatacaaattcgacactattgccgataacgaaaacctcaacgtcagctccaaaggcggttgggtggcaatgttgcagcagtatttcgctaccgcatggattccgcgtaacgacggcaccaacaatttctacaccgccaatctgggcaacggcattgtcgctatcggctataaagcgcagccggtactggtacagccaggccagactggcgcgatgaccagcaccctgtgggtcggcccggaaattcaggataaaatggcggctgttgcaccgcacctggatttgaccgtggactacggctggttgtggttcatctctcagccgctgttcaagttgctgaagtggatccacagctttgtgggcaactggggcttctccattatcatcattacctttatcgttcgcggtatcatgtacccgctgaccaaagcgcagtacacgtcaatggcgaagatgcgtatgctgcagccgaaaattcaggcgatgcgcgaacgtcttggcgatgataaacagcgccaaagccaggagatgatggccctgtacaaagcggagaaggttaacccgctgggcggctgcttcccgctgatcatccagatgcctatcttcctggcgttgtactacatgctgatgggttccattgaactgcgtcatgcgccgttcgctctgtggattcatgacctgtccgcacaggacccgtactacattctgccgatcctgatgggcgtaacgatgttcttcattcagaagatgtcgccgaccaccgtgaccgacccgatgcagcagaagatcatgacctttatgccggtcatctttacggtgttcttcctgtggttcccgtcaggtctggtgctgtactatatcgtcagcaacctggtcaccatcattcagcagcagctgatttaccgtggtctggagaagcgtggcctgcatagccgcgagaagaaaaaatcctgattcggtgtaggccggataaggcgaagccgccatccggcaaggcgcgccggtcagcctgatggcgctaacgcttatcaggcctacaatcaaaaggcggtcatatgaccgcctttttttattgcaacaaagttgagactaaccatgagccataacgacactatcgtcgcccaggcaaccccaccgggacgcggtggcgtgggtatcctgcgtatttccggtctgaaggcgcgcgacgttgcgcaagaggtgctgggcaagctgccgaagccgcgctatgccgactacctgccgtttaaagatgttgacggcagcgcgctggatcagggtattgcgctgtggttccccggcccgaactccttcaccggtgaagatgtgctggagctacaagggcacggcggtccggtgattctggacctgctgttaaaacgtatcctgacgcttccaggcgtgcgcattgcccgaccgggcgagttctccgagcgagcgttcctcaacgataagctcgatttagcccaggcggaagccattgccgacctgatcgatgccagttccgaacaggcggcgcgttcggcgctaaactcgttacagggggcattttccgcccgcgttaaccaccttgtggaagcacttactcacctgcgaatctacgtcgaagcggctattgattttccggatgaggagatcgactttctctctgacggcaaaatcgaagcgcagctcaatggcgtcatcgccgatcttgacgccgtgcgcaccgaagcgcgccagggcagcctgctgcgcgaagggatgaaggtagtgattgccggacgcccgaatgccgggaaatccagcctgctgaatgcgctggcaggccgtgaagcggccattgtcaccgatatcgccggtaccacgcgcgacgtgttgcgcgagcatatccacatcgacgggatgccgctgcatatcatcgataccgccggactgcgcgacgccagcgacgaagttgagcgtatcggcatcgaacgcgcctggcaggagattgaacaggccgatcgcgtgctgtttatggtggatggcaccacgacggacgccgttgaccctgccgacatctggccggactttatcgcccgtctgcccaaaaatctaccgattaccgtggtacgtaacaaggcggatatcaccggcgaaacgttgggtattagtgaagtaaacggtcactcactggttcgcctctcggcgcgtaccggcgaaggcatcgacgtgttgcgtaaccacctcaagcaaagcatggggtttgataccaatatggaaggcggcttcctggcccgtcgccgtcacctacaggcgctggcggaagccgctgaacaccttgagcagggcaaagcgcagctattaggcgcatgggcgggggaactgctggcggaagagttgcgcctggcgcagcaaagcttaagcgagattaccggcgagtttacctccgacgacctgctgggacggattttctccagcttctgtatcggtaagtaagttttagtccaccctcgtcagtgaacgttcactaacccgcattaactgcctgttaacgcgggtttttactttccatactcgtccatagtcgtgcgggttcatccgcgatttttgtgtcctgaattgtccccatctttaaatccctcgtgtaccattgtttactttttgatctaaaaattacatcaaatgaacacaaaaaacggtataaaaaacgctcaaatatcccttctcatggacacactatagaggtgagatatggcactttcagataccaaattacgcacacttgctcccagaaaccgcccctggcaacttgccgatcatgacgggttggtgattgaagttcttcccaccggacgaaaaatctggcgtttccgctaccgctttgacaacaaatcgcaacagatcacgctgggcgaatacccagctttctcacttgcagaagcgcggctctggcgtgaaaagtgccgctcactggttgcccatggcatcaatcccgcgcagaaaaagcaggaagaaaagcttaaacagaaagacccaacgacagtcaaaacattcgccaaacgctggctgaccgatatcgttgaaaaaagtaaccgcgatccacgcaacatcactcgcgttatcgagaaggacatcattcccatcatcgggaagctggaactcgaagaactcacaactgcccacattcaggtcgtgctcgaccgcatcaagcaacgaggttcggatcacgtcgcattactgacgtgaaacgtgcttaaacgcatgctggcctatgcaatttccaggggaatcatcttcaacaacccggcagcggctatcgaggctcgttatatcacacaagcaacaagtcgtgatgtggcactgaccgcagaagagatcggcatcctgttacgggggatctacacctctaacatgaaccgacgccacaagctggccctgcacctgctgatcatctgcatggtgcgtaaatcggaattgattgaagcaacatggagtgaagttaacttcaacgcgctggaatggcgtatccccggcgaaagaatgaagatggataatccacatattgttccgctgtcaaagcaggcgctggcgatgttcgaagagctaaaatttctggccggagattccccttacgtcttccccagccgacacggctaccgacgtccgatctccaaaacaacgctgaactgtgcggtgcgtacgctggatctgaacgtcagggattttgttattcatgacttccggcgtactgccagcacattgctacatgagcagggctacaactcggattggatagagaaatacctggcgcataagatcggcggcgttcacggtgtctacaaccgtgcggagtacctgaatcagcgccgggagatgcttcagtcttgggctgattttgttgatgcgcagattgagactggaaggaaggttatcattggacaattcgggaagtcttacaatgtaaccgtatgaataatatggaaaatataacaataatagtttctgattagaatatactatctaaccggttgaaaaagatgcacttctcaaccataataacatcactctttagcgttaggctttgatttatagccttgtcgagcgtttcgccagacactaacttattgagtacttttagggttgcgctagaaagttttctaccgatcctagaagtctctaggatcggtagaaaactttctagcgcctcctctagtaaagagtaaaaaacgagcaaaaaacattgctcgtttttttcatcaacggaagacaaatcaaaaatacataacgtttaaatcaatgtttgaagaaactattaaaaaacaatttgaattgttagacataagtaacttcaatgttgatatatctcatcgtctccttttcgtgtgtggtggcaaagtcgatgtacgtgcaccaattccccccagttttagggatagactactcacttacacagcaaaaaatgcctctgaacttcacgaacatttcattctagctgagacattcaaggattattttaaagagaatgcctatccggaccttctggtgtttgaagatgatatagccagtatttcatctcttattatcatttttttagaaagcccaggatcattagttgagttaggtatattttgcaacaaatcagaactatttaaaaaaatactgattgttgcttcagcggaagaagtatacggtgaggactcattcatttatttaggcccactagagtatattaagaagaaagtctcatcctctgttgtaatctatccttggccggatcctgaagtcttaaaatacgataatgattttcttgatgatttatgtgtaaatataaaagaaaaactttcatcaatcccaaaaacagaacaattcagtaaggataattctggacatatagcacttctaattactgaaattatatctctttgcgccccaatacaacttagtgaaatagaatcagccctaaactcattagggattaatatttcaacaaaaattattaacagatcaatttatttacttcagaaagttggttttatagacgttttatcatatagctcaaacaaatattactttccattaaaagagcgcaaatgggtaaaatttggtaaaactaaagataataaactcatagataatcaacaattaaaaatgaaggttagacaatcttttgtaacattaaccgatccattatcaaaacgaagaattacagcgctgcgtcaaataatagcaaaaaaagaaatggctgaggagattaattaatggacatattacagcatatttcagatttactattaaccaagaaaagtgaaatcatttccttttcattgacggcaccttatcgctataaaatatataaaattgcaaaaagaaactcagataagaagagaactattgctcatccttcgaaagaactaaaatttatacaacgtgaaattactgagtatttaaccgataaattacccgttcatgaatgcgcatttgcatataaaaagggcagtagcattaagaccaacgctcaagttcatcttcatacaaaatacttgttgaagatggattttgagaattttttccctagcataacaccacgtctatttttctcaaagttacgacttgcaaatattgatttaactgcagatgataaagtactacttgagaatatattattcttcaaatccaagagaaatagtaatttaagattaagtattggagcaccaagctcacctttaatatcaaattttgtgatgtacttttgggatattgaggttcaagagatatgctctaaaataggcgttaactatactcgttatgctgatgatttaaccttttcaacaaataataaagatgttttgtttgatatacctgacatgcttgaaaacgtactgcctaaatattctttaggtaggattagaatcaatcatgaaaaaacagtgttttcttcaaaaggacataaccgtcacgttactggtataactctaacaaacgataacaaattatccataggtagagaaaggaaaagaaaaatctctgccatgatccatcattttataaatgggaaattatctactgacgaatgcaataaattagtcgggctacttgcatttgctaaaaatattgagccttcgttttataaaagcatggtcattaaatatggatctgataatatttataaattacaaaaacaaaaagacaaataatttctgctgcacttttatagacaccagtgttttgttgattatgcccagaacaacttggaataagttttcctaagcgtattacattatacgcttggcctaacttaatcatagattttccagaaaaataaatttttcaaatcccataaacaattccccacagcttccctacgcccccggtcaaccagggaacgaagcgtggcctgaaactgacctcctgtctcgatacaggtgaccacaccctttatcgctaccctgttgcaagcgtagcggcagacagaacgctgtagataagtcggacggcattgccgaaggctttccgtccgtacttcctgctgaatgtgcaaaacgcggcgtcacttttaagagcgtaagagagtgaaagtgacgccagcgcgcagatcagcttcaacccggctactgcctgcaaatccactgcaacaaactggctgacactcaaacagatgtcagaaattcacttaccagggtcaatctggccgggatctcaaaaaatgcatggaactaaaacgggtctatttacagtttcaccagctacttggtttttgtgtcctttaatgtgcccatagccatgttttcaaggcaaattatagattatatatcaacgaattatctagattttccagtttctgtattggtgtcgggtgacggctgacgccatccggcttacgtcactgccggggtgatatctcattgcctcataggaaatcactgttgtccaaatggcaactcgtctcgcgcaacatcgccccgtattcttagcgccacacttttcgtgaggccgctatgaaacgttttctactgtgtagttttgccctggttttactctatcctgccggtattgatatgtatctggtcggtttaccgcgtatagccgccgatctgaacgccagcgaggcgcagttgcatatcgccttctccgtttacctggccggaatggcgacggccatgctgtttgccgggaagatagccgaccagtcaggccgcaagccggtcgcgatcgtcggcgcgctcgtctttatgatggcctcactgctttgttcacgggcgtcggaaggctcgctatttctgagtgggcgttttcttcagggagtaggcgcaggcggctgctatgtggtggcgttcgccattctgcgcgacacgctcgacgagcatcgccgggcgaaagtgctgtcattattgaatgggattacctgtattgtgccggtactcgccccggtggtggggcatttgattatgcttcgtttcccctggcaaagtctgttctatacgatgtccgcgatgggcattattgtgggcctgttatcactgtttatcctgcgcgagacgcgcccggtaaggctggctccacgcgatttatcacgatcgtcgcccgccgccgagtcgctgattaaccgttttttcgttagtcgactggcgatcaccacccttagcgtgtcggtgatcctgacctttgtcaatgcctctccagtgctgctgatggaggtgatgggatttagccgtggcgactatgccattaccatggcgctcaccgcaggcgtcagtatggtcgtctctttttccaccccttttgcgcttgggttatttaagccgcgaaccttaatgctcgtctcacaggggctgtttttgacggctggcgtgacgttaagccttgctcataccaataccgtcacactctttggcctgacgcttatctgcgccggattctcggttggttttggcgtcgcgatgagccaggcgctggggccgttttcgctgcgcgccggagtggccagttccacgctcggtatcgcgcaggtttgcggttcatcactgtggatttggctggcggcaatactcggtatcagcgcgatgaatatgctgatcgggattctgattggttgtagcatagtgagtattctgctgatcttctccgtcacgcccaacaggtccgtagccgagcatgaagaaatcccttaccaatctcgaccttaatttgctgttatgcctacagttactcatgcaggagcgcagcgtcactaaagctgcaaaacggatgaacgtaacgccctcagcggtcagcaaatcgctggcgaaactccgggcatggtttgacgatccgctgttcgtcaatacgccgctgggcctggcgccgacgccgctgatggtcagtatggagcaaagtctggcggactggatgcagatggggaatcaactgcttgataaaccgcatcatcaaacgccgcgcggtttaaaatttgagttggcagcagagtcgccgctgatgatgattatgtttaattcactgtcgcagcagatttatcagcgctatccgcaggctaccattaaggttcgcaactgggattatgactcgctggaggcgattacgcgtggggaagtcgatatcggatttaccggacgcgaaagccatccccgctcgcgagaattgctcagtctgttaccgctcgcgattgattttgaggtactgtttagcgatttaccgtgggtctggctgcgggaagatcatccggcgctgcgcgaagcgtgggatctggacacttttctgcgctacccacatatcagtatttgctgggagcaaagcgatacctgggcgctggacgatgtcctgcaagaaatgggacgcaaacgccatatcgcgttgagcctgccggggttcgagcagtcgctctttatggccgcccagccgggtcacaccctgatagcaaccgcgccgcgctattgccagcactacaatcagctccaccagctaccgttagtggcgcgccccctgccttttgatgcgcaacagcgggaaaagctgatggtgccgtttaccctattatggcacaaacgtaatagtcataatcccaagattgtgtggctacgacaggctatcaacacgctctgccgtcgccttatctgaccacctgcgttgataaattaaccttcctcttaccagaaatgtcaccatctgattaaagaaccttctgaaattgaatttttagcgcgtaaaacctgtccataatttacgttaatgttactctcgtcattatcacggcccattaatcacggagcgaaaaatggcgactcactttgccagagggatacttacggagggacagttggtttcaattcgtctctcttcgtcttgccatattgaagccagaaacctgcctgctcaccgacgaacgcgttttctcgcctccagaggccttcttgccgaactgatgtttatgctgtacggaattagcgagctgccggaaatcattattcaggcgaaaggtaaacccgcgtttcgtgacaaaaatctgccaggcttttctatctcctatgccggaaatatggttggcgtggcgttgaccaccgaaggagagtgcgggctggatatggaattacagcgcacctcccgcggctttcaccatccgcattcgctcgaacgccaccctttctcccgtaatgaaaacttatgggtagccaatcaaaacgatcccaacgaagcgcgagcgcaactcatcacattgcgccagagcgtgttaaaactcaccggcgatgtcatgaatgacgatccgcgggagctgcaacttttacccgttgccggacgcctgaagtgcgcgcatgtcacgcagcttgaagccgtgtgcgatgcggaagatgtgctggtatggtccgtaaccgttacgccagcgatagaaaaattaaaagtgtgggagttcgatggcaaactgggctggaaaagcctgcccgatatccagacgcgcgccaatgagccaaccggtcgtctgatgcgattcgcccaactccccgccgccaaatcgtatacgcttaatcgttcataatgaaaaaaggggcacgtatgtctgaaacgctgaatgtggttacactgctgggaagtttacgcaaaggttcctttaacgggatggtggcgcgtacgctgcctaaagtcgcgccggcaggaatgacggtatcgccgctgccttcgatcggggatattccgctgtatgacgccgatatccagcaggaagagggatttccagccagcgtagaggcgctggcggagcagattcgcaacgccgacggcgtcgtcattgtgacgccggaatataactattccgttcccggcggcctgaagaatgccatcgactggctatcccgtctgcctgagcagccgctggcgggtaagcccgttcttatccagaccagttcaatgggggcgattggcggcgcgcgctgccagtatcatctgcgccagattctggtgttccttgatgcgatggtgatgaacaaaccggagtttatgggcggcgtgattcagaataaagtcgacccgcagactggagaagtggtggatcagggaacgttagatcatttgaccggtcagttgaccgcatttggcgagtttattcagcgcgttaaagcgtaagttcgttaaaaaccctccccccgatggggcgagggttcatttcatcagtgtgcgtcaataaacacaatcttcagcacaaataacagcgcgacaatcactacgcacgggctaaggtcgcgcaggcgaccggtaccgattttcatcacgcagtaagagataaagcccagcgcgataccttcggtgatcgagaagctaaacggcatcattaccgccgtaataaacgccgggaccgattcggttaaatcctgccagtttacccgcgccaggctggaggtcatcagcacgccgacgtaaatcagcgcgcccgccgccgcgtaaggcggcaccatgcccgccagcggcgacaggaagataaccagcaggaacaaaataccgaccaccaccgccgtcaaaccggtgcgaccgcccaccgaaacgccggaagaggactcaatataagcggtcacagaagacgttccgacaaatgcgccagtgacagaagagatactatcaacaaacagcgcctgcttcatgcgcgggaatttgcctttctcatccgccaggccggctttatcggtcacgccaatcagcgtaccggaggagtcaaacaggtttaccagcatgaaggagaaaataacccccgccaggccaagattgaacgagcctgccaaatcgacatgccctaccacgctggtgacgcttggtggcgcggagacaataccgttgtagtgtacatcacccatcatccagccaagcagcgtcgtgacgatgatggacaccagcaccgccgcatgaatgttgcgcgaagcgagaatcgcaataataaagaatccgagaacccccagcagcacgctgtgcgaggtcaggttgccgatgctgaccagcgtttccgggttagcgacgatcacgccggcgtttttcagccccatcatgccgataaacaggccgatgccgctggtgatgcccacgcgcaggctgaccggaatgttggcgatcatccagtaacgcacgcggaagatagtcagcaataaaagaccaacagcgccccagaaaatggcgcccatgcctacctgccacggcagtcccattgcctgcacaaccacgaaggcaaagaacgcattcagccccatcgcgggcgccagcgccaccggcaagttagcgaacaggcccatcagaatactgccaaaggccgcaatcagacaggtggtcacaaagacggcgctggtgtccatgccagctacgcccagaatttgcgggttaacaaaaacgatataaaccatcgtcaggaaagtggtaaaaccggcgatcacttcggttcgtgccgtcgtgccatgttcgcgcagtttaaacacgcgttccagcataccctgaccagaagcctgggtggtgtgttgttgactcattatcaatttccggagaaaggagggaaaattcgccgttatcctataccaaaatgcgacacctggcgcagttgtgtggtaatttttttcactcaatttgttagtacggcaacgattgcgtcccctcattcagcattacgtaaacgttaaacttgttaaaatggaaatgacatgtcccaaatcgaagcagtgttttttgactgtgacggcacgctggtcgacagtgaagtgatttgctcgcgcgcctatgtcactatgttccggcagttcggcattacgcttgagctcacggaagtattcagacgctttaaaggcgtaaagctctacgaaattatcgataccatcagtaaagagcatggcgttgcgctggcaaaggcggagctggaacccgtgtaccgcgcggaagtggcgcgcctgttcgataccgaactggaagcgatcgcgggcgcaaataccctgctggagagcattaagacgcccatgtgcgtggtatccaacgggccggtcagtaagatgcagcattcgctgggtaaactgggcatgttgcatcattttcccgatttgctgtttagcggttacgatattcaacgctggaagcccgatccggcgctgatgctccatgcggcgaacgccatgaaggtcaatgttgagaagtgtattctggtggatgattccagcgcaggcgcgcagtcaggaattgcggcgggaatggaagtattttatttctgcgccgatccgcataacaaaccgatcgatcaccctaacgtgacgacgtttaccgatttggcgcagttgccgggattgtggaaagcgcgcgggtgggagattacgcgttaactgaaatgcccggtggcgctaacgcttatccggcctacagcatctgtacctgtaggcccggtaagcgcagcgccaccgggcaaaagaatgagatttactctttcggatctttccccgccagcagcttatccagctcatcgccgccgacgtgacggaaatcctgccccttcacgaagtagaagatgtattcgcagatattctggcaacggtcaccgatacgctcgatagagcgcgcgcagaataacgcggtcagcacgctgggaatggtgcgcgagtcttccatcatgtaggtcatcagctgacgcacgataccttcgtactcctggtcaactttcttgtcttcacggtagatacgcaccgcttcgtcgagatccatgcgcgcgaacgcatccagcacgtcgtgtagcatctgcacggtgtggcggcccagtgactccagactcaccagcagcggctgatgctgctgggagaatttctccagcgcggtacggcagattttatccgccacgtcgccaatgcgctccagttcggcgatggttttgataatcgccatcaccagacgcagatcgctcgccgtcggctggcgcttggcgataatacgcacgcaggcttcatcgatggcgacttccatcatattaacctgatgatcgccttctaccacgcgcttcgccagctcgctgtcctggttgtgcatggcggtgatagcgtcagaaagctgctgctccaccatgccgcccatggtcattacctgagtgcggatgctttccagttcggcgttgaactggccggaaatatgtttattaaggttcagactgtccattacgcactcctgaattaaccgtaacgaccggtgatatagtcttctgtttgtttcttcgcgggcttggtgaacagatcgtccgtgttgctgaactcaatcaactcgcccaggtacataaacgccgtatgatcggagcaacgtgccgcctgctgcatgttgtgggtcacgatcaccacggtgtaatcctgtttcagctcggtgatcagctcttcaatacgcccggtagagatcgggtccagagctgaacatggctcatccagcagcagcacttccgggcgaatggcgataccgcgcgcaatgcacagacgctgctgctgaccaccggagagagagtacccgctctggtgcaatttatctttggtttcgttccataatgcggctttggtcaacgcccactgcacgcgctcgtccatatcggcgcgagacagcttctcaaacagacgcacgccaaaggcgatattgtcatagatggacatcgggaacggcgtcggcttctggaataccatccccacttttgcgcgcagcagcgcgatatcctgggtgttggtgagaatattgtcgccatccagcagaatttcaccttccgcgcgctgctccggataaagcgaatacattttattgaaggtacgcagtagcgttgatttaccgcagccggatggcccgataaatgccgttacctgattcttcgcgatatccagattaatgttcttcagggcatggaatttgccgtagtagaagttcaaatcacgaacctgaatcttactcggggcagtttcaaccatactcatttcactcttttcctcatccagcgccgcatccgccacgccgtaaaataatgcctgatggcgctacgcttatcaggcctacaatgtctttaaccgtgttttttcttcgcgaaaacaacacgcgccagaatattcagcagcagtacgcacagggtaataatcagcacgcccgcccaggctaattgttgccattcggcaaacgggctcatcgcgaatttaaaaatggtcaccggcaggttggcgatcggctgcatcatgtcggtgctccagaactggttggagagcgcggtaaacaacaatggcgccgtttcgccggcaatacgcgcaatagccagcaggataccggtcataatgccggagatagaggctttcagcgtaatcgcggaaatcatcttccacttcggcgtacccagcgcataagcggcttcacgcaggctatccggcaccaatttgagcatgttttcagtggtacggataacgatcggtacctgcaacagcgccagcgcaatcacccctgcccagccggagaagtgctgcatctgcgccaccacgatggtgtaaacaaacagccccacaacaattgacggcgcggaaagcagaatgtcgttaataaagcgaatgatttccgccagccaggatttacggccatattccgccagatagatcccggccataatccccagcggcgtacccaatacggtagcccagagaatcaataatccactccccgccagggcgttcgccagcccgccgcccgccgtgttcggcggcggcgtcatttcggtaaacagcgccagcgacatcccgtcgataccacgcgtgatggtggacatcaaaatccagatcagccagaacaggccaaatgccatcgtcgccattgagagcgttagtgcgatacggttcttcatgcggcgacgcgcctgcatcttgcgacgggattccgcgagctgcgcggtgttctgcatatcaagcgtagccattaacgtgctccctcgttcttcgccagacgcataatcatgaacttagacgccgccaggacgataaaggtgatcacaaacaggatcagccccagctccatcaacgctgccacgtgcaggcccgattccgcctcagcgaattcgttcgccagcgcggaagtgatgctgttgcccggcatatacagcgacgcgctgtcgagctggtaagtgttgtcgatgataaaagtgaccgccatcgtttcacccagagcacggcccagccccagcataatgccgccgatcacgccatttttggtgaacggtagcacgatgcgccagataacttcccaggtagtacagccgataccgtaagcggactctttcatcattaccggtgtttgctcgaagacgtcgcgcataaccgccgcaatgtaggggatgatcatgatggcgaggatgacgcccgccgccagaatgccgataccaaaggccgggccggagaacagcgcgccgacaaacggaatgttggaaagaatattgccgaccggctcctggaagtacgtcgcaaacagcggcgcgaagataaacagcccccacatgccgtacacgatactgggaattgccgccagcagttcaatggcgatgccgagcggacgctttagccagcctggcgccagctcggttaaaaacagggcaatgccgaaactgaccggaacggcgatcagcagtgcgataaaggaggtcaccagcgtgccataaatgggcaccagagcgccgtagatatcgtttggcgcgtcccattccttagtccaaagaaatgagaaaccaaatttctgaatacttggccaggaggagatgatcaatgagacgataataccgcccaacatcaatagcacaatcagcgcagccagttttaccagcgcgctgaaaatcatgtcgccttttttacccggcgggttaaaagcaggcttggttgcagccataaattactctttccattaaacgcattttacgacgttgcccctgccggatggcgctacgcttatccggcctacaacgtgggcctgcggtcgaaaccgtagggcggataagcgtagcgccatccgccaattcgttaattaatacagcgccttaccgttgctgtcttttatactggtcttccatgcagcacgaacctgctcaacaacgttatccggcaggctggcgtagtccagatcattcgcctgcttagcgccatttttgtaggcccagtcgaagaacttcaacacttcagcaccctgctcaggtttcttctgcgctttgtggaccaggataaacgtggtggaagtgattggccacacatcgtcacctttctggttggtcagatcctgcgcgaaggttttgctccagtctgcgcctttcgccgcattagagaagctctcttccgtcgggcttaccggtttgccgtcggcagaaaccaatttggtgtaggccaggttgttctgcttggcgtaagcgtattcaacgtagccgatagcgcctggcagacgctgtacaaatgccgcgatgccgtcgttacctttaccgcccagaccggttggccagttcacggtagaacccgcgcccactttcgatttccactcgtcgttgactttcgccaggtaactggtgaacacgaaggaggtaccggaaccgtcagcgcgacgcaccacagcgatgttctgagaaggcagcttcacgcctgggttcagtttggtgatggcttcatcatcccacttcttgattttaccgaggtagatgtcacccagcgttttaccatccagcaccagttcgccggatttgaggcctggaatattcaccgccagcaccacgccgccgatcaccgtcgggaactggaacaggccttcctgattcagtttttcgtcagacagcggcgcatcggaagcgccaaaatcaacggtattcgcggtgatttgtttcacgccgccggaagagcctatcccctggtaattgactttgttaccggtttctttctggtaggtatccgcccatttggcatacaccggcgcaggaaacgttgcaccggcacctgtcaggcttgctgctgcaaaggcagagaacgcgctcatcgataaggtcgcggcgacaacagttgcgacagtggtacgcataactttcataatgtctcctgcacggtttcggtaaatcgttgtttgagttgctacgatgagcaaaataggacaaattgatgacagttatatgtcttgattatgacggtttgatgacaatggaaataaaaaaagctggcccggggagacaccagaccagcctgcagggggagatgaattagactgtttgcgcaaccgcagacggtttcaacagcgcgtacatcaggccgcagacaatcgtgcccagggcaatcgagagcagatattgcatcacatgttctaccgcatgcgggatcgccaggacaaagaggccaccgtgtggcgccatcagtgtacaaccgaaatacatggacagtcccccggcgattgcgccaccgaccatcgtggaagggatgacgcgcatcgggtcacgcgcggcgaagggaatcgccccttcagagataaagcacagccccagaataaaagatgcattacccgcttcatgctcagcggcattgaatttcgctctggccgcccaggttgcgacgcccattcctaatgccggtaccatccctgccgccataatggccgccatcggcatataggaatgagaagccagtaaaccgacgccgaaggtatacgcagctttattcaccggcccaccaaggtcaaaaccttgcattgcgcccagcaacattcccagcaagatagcattcgtagaggtcatattccccaggaacgtcgtcagcccttccatcaccgcagacaccgggccacccaccacgtaaatcatgattaggccggtaatcagcgtagacagtagcggcagaaccagcacaggcttaagcgcttccattgacgctggtagcttaatattttgcgccagaaaccgtacgctgtaaccggccagaaaaccggccacaatccctcccaggaaaccggcgccgcacaggctggccaacatcccgccaataagccccggggccagacccggacgatcggcaattgagaaggcaataaacccagccagtaccggcaccatcagcgcaaaggccgccttaccaccgatttgaaataacgcagccgccagcgtgcccggctcgttgaaggcctggataccgaagacaaaagagagtgcgatacacaatcctcccgccaccaccaaaggaagcatatgggatacgccggtcattaaatgcttataaacgccgggtagctctgttttaccagctgaagaagagcgcccggcactcccctgatagacctcggcgctattgaaagcattatccatttcctgcgcactcttttttagcgccgcgccggtactggtgcgatagagtcttttgccaacaaagcctgacagatccagctcaatatccgccgcgataatcaccacatccgcctgcgctatctcttccgcggtcagcgtgttcttcgccccgacggaaccgcgggtttcaaccttgatccagtcaccacgcttgcgggcttcaatttccaacgcttctgccgccataaaggtatgggcgacgcccgtcggacaggccgtcacagcaacaatttttttagtcatagtagggtaccctgttcttttaatttaaagaaaaagcgggaaaaaatgttacaggcgtgaccaggccgctgctttctggaacagcgcgtcatccgggcgaatcccggtataaaggacaaattgctccacggcctgaatagcaaacacttcggaaccggtaatcacggttttaccgcgttcacgggcgtagcggattagcggcgtgacgggcggtagcgccaccacatcaaagataacgctcgccttatccacttcctgttcggaataagaaagtttgtcggcatcattaccgccagccattccgataggcgtggcgttaattaacaaatcagcttcaataccgtcggtatccgggcgccattcatagccatagagttcggccagttgtttacctgacgcttcatcaatcgcgacaatataaccacgggtaaaccccgcatccttcagcgcgcaggccaccgcctttgccataccaccgctgccacgcaaagcaaacaccaggtcgggagagaccttgtaattcgccagcaagcgagctattgcaatgtaatcggtgttgtacgccttcagatggccattggtattcacaatggtattaactgagtgaatggcctgagcggaagcatccagttcatccaccagcggaatgcaggcttctttaaacggcatagagatcgcgcatccacggatccccaacccgcgcacgccgctaatggcctgcgtaagatcggtcggcgaaaaagctttgtagagataattgagatccagcgcttcgtacagatagttgtgaaagcgtgtaccgaagttacttgggcgtgccgccagggacatgcagacctgagtgtctttattaatgcgctttgtcatgatgaatcctcatagaagttgcgatagagaaaatcatcggctaaaaaggggatattaaaaattgctcattcccgttcgggaaatttcaccttttatgacaacccggcacactgaacaaaaatacttaaagctactccagcactatggcgacaagcctgttagcgtgacattacaggagctggcggatgtgttgttctgcacccgacggcatatgcgtaatctgttgcttcagatgcaggaggcaaagtggctcatctggcaatcacaggccggacgtgggcatcgcgcccggcttcacctgcgctataaaccagaacagctgttaagcgaaaaggcggagcagttactggagtctggtcatattgatcaggccattcagctgctgggtaaaaataagcaccaggtggcgcaactgctgcgttcaaagctgggctatagcgtgcgggcagactatcagcggctgtgcatcccctattatcggacaatgccgtcgctgtgccccggcataccgttgcgtcgctctgagcagcatctggtcaggcagatttttagcggcctgacgcgcataaatgaggaaaaaggtgaagtcgaagccgatcttgcccaccactggcggcagattgatccactgcgctggcgtttttatctgcgccccgccgtcctctggcatgatggtcaggagctgacgatcgacgcggttatcgcttcactgacccgcagcgctaagctgccgttgttctcgcacttgcagaccattcaggccaccgggccgctgagccttgaaattacgctggcgcacccggataaccgactgccgctgctgctcagccatattgatgccatgatcctaccgcctgaccatacacaacgcgctgatttcccggcacatcctgtggggactggcccttatgaggtggtggaaaacaatggctttcatctacaaatgaaggcctttgaccactatttcggtctgcgcgggctgctggatgaagtggaggtctttatctggccgaatttaacggagacagacaacctggcggaatcgctgtcggataacgacacggcagcctggctcagctccagcctgagcgatgaggattacgtttccggacggcttagccaggtatcaggcaaaccttctgacaacctgcgcgagatgtttcttgagcgtggaggatattttttattatgcgacagccgctccccgcactggcataccgccgaacatcgccgctggctacgggaaacactcagcccttacgccatactccagcatctgagtgaggcaattcgccccttctgggtaccgggcggcagcctgctgtcctcctggtttcatactattgaggcgggcccggcctgttcaccttttatctcgtcgtcgccctacgcaaaactgcgtctggcctatcacgatcagcaccctgaatttccaatgctcctggatatcatgcaagagatcatgcgccagcagggcattttacttgagggcgttgagctgaattatgatgactgggcgaatggcaaagccaatgtggatctctggctggggacggtcaatttccccattcccgaagagtggaacgtcggtacatggctactgggctcccctttactgcgccacgccatcagtggtggggatgatgcgctgctggcccaatgggaaacccagtggcatgccgaaaccatcagcgcggaacaactggtcagggaaaccacccgttcaggctggctacagccgctttttcaccactggatgcgactcaaaagccccgaccgggccagggggatccacctgaataacctggggtggtttgatttccgatccacctggattgagccagggccttaaagaagagaatgtgaccgggtgcccgtagcgcaggcaggcgtagcacctcttagtcgctcttcagccaccatagagaaagaacagcgcctgtcacagcgcacaaaaaaaggccgtctgtcgacggccttctgcctggtactacatttgtacttactctacggtaaccgatttcgccaggttacgcggctggtcaacgtcggtgcctttaatcagcgccacgtgatacgccagcagttgcagcggaacggtgtagaagataggcgcaatgacctcttccacatgcggcatctcgatgatgtgcatgttgtcgttgctgacgaaacccgcatcctgatcggcgaagacgtacaactgaccgccacgtgcgcgaacttcttcgatgttggatttcagtttctccagcagttcgttgttcggcgccaccacaatcaccggcatatcggcgtcaatcagcgccaacggcccgtgtttcagctcgcctgcagcataggcttccgcgtgaatgtaagagatctctttcagcttcagcgcgccttcgagcgcaatcggatattgatcgccacgccccaggaatagcgcgtgatgcttgtcggagaaatcttctgcaagcagctcgatgcgtttgtcctgcgacagcatctgctcaatacggctcggcagcgcctgtaggccatgaacgatatcatgctcaatggacgcatccagacctttcaggcgagacagtttcgccaccagcatcaacagcacggttaactgggtggtgaaggctttggtagatgctacgccaatttccgtacccgcgttggtcatcagcgccagatcggattcacgcaccagcgaagagcccggcacgttacaaattgccagagagcccaaatatcccagctctttcgacagacgcaggccagccagggtatctgcggtttcgccagactgtgacagggtgatcatcaggctgttacggcgcacggcagatttgcgataacggaattcagaggcgatttcaacgtcgcacggaatacctgccagcgattcaaaccagtaacgggaaaccataccggagttgtaagacgtaccgcaggcgaggatctgaatatgctcaaccttcgacagcagttcgtcggcgttcggtcccagctcgcttaaatccacctgaccgtggctgatgcgcccggtaagggtgtttttgatcgcgttcggctgttcgtagatctctttctgcatgtagtggcggtaaatacctttatcgcccgcgtcatattgcagattggattcgatatcctgacgttttacttccgcgccggtgttatcgaagatatttaccgaacggcgagtgatttcagcgatatcgccctcttcaaggaagataaagcgacgagtcactggcaacagcgccagctggtcagaagcgataaagttttcgcccatacccaggccaatcaccagcgggctaccagaacgtgccgccagtagggtatccgggtgacgggtatccataattaccgtaccatatgcgccacgcagttgcgggatagcacgcagaacagcctcacgcagagtaccgccctgtttcagttcccagtttaccaggtgtgcaatcacttcggtgtcggtttcagaaacgaaggtatagccacgcgcttttaacgcttcacgcagcggttcatggttttcgatgatgccgttatgcaccaccacaatgtgttcagaaacatgcggatgcgcgttagcttctgaaggttcaccgtgcgtcgcccagcgagtgtgagcaataccagtgccgccatgcagaggatgttcttccgctgcctgagccagcatctggactttaccgaggcgacgcaggcgggtcatatgaccttctgcatccaccacggccagaccggcagagtcatatccgcggtattccagacgacgtaaaccttcgagaaggatttcagctacatcacgctgcgcgatagcgccaacaattccacacatagttttatttcctgattatggcattacgccatgcgttgtcgctgacctgtatgcccgtcgttgcgggcgccccgagccttgtagagagtggggttatttttataagtactgctcatggagcggaggattattttatcctctcatctccggtctgccggatggcgctgacgcttatccgacctacaaaatcactttttcttcaccggacgctgccagccttgcttatgcacctgcggcacgcggcttaataccagttcattgtcggctacattacgggtgacggtagtccctgcggcgatggtggcccctttaccaacagtaaccggcgccaccagttgggtatcggagccgacaaacacatcgtcgccaataaccgttttgaatttgttcgcgccatcatagttacaggtgatggtccccgcgccgatattcacgttgtcgccaatttccgcatcgcccaggtaggtcagatggccggctttagaacctttaccgagacgcgcttttttcatttcaacgaaattgccgacgtgagcgcccgctaacagctccgcgccgggacgcaggcgagcaaacggaccgatggtgcaggccgcttccagatgcgcatcttccaccacgctgtatgggctaatttcgcagtcatcgccaataacgctgtttttaataatgcagcccgcgccgatcttcacgcggtgaccgagcgttacataaccttcgatgataacgttagcgtcaatttccacatccattccacaatgaagggtgccgcgaagatcaaaacgtgccggatcgcgcaacataacaccggataacagcagtttctccgcctgttcggcctggtaaatacgctccagacgagaaagctgtagacggttattcacgccgtccgtttcgctgatgcgagccggatgcaccgcggcgatttctcgtccttcctgataagccagcgcaatgatatcagtgatgtaatattcaccctgcgcattattgttagtcagcttagacaaccaacgtttcatgtccgcgccgttggcgatcagaataccggtgttaatttcctgaatctgacgctgttcatcagtggcgtctttatgttcaacgatgccggtcactttaccgttttcacgcgtaatacggccatagccgctcggatcgtccagcttcacggttaataacccaataccaccctgcggtttggcatcgcgcaggcgctgtaaggtttcaaccgaaatcagcggcacgtcgccgtaaagcattaaaatatcttcatcgtcgctaaagaagggcgcggcctgctgcattgcgtgacctgttcccaactgttccgcctgaagcacccagttcagcttgtcatctttcagggtctgttttaacaactcgccaccgtggccatagaccagatgaacctgtgcggcccctaatttagtagctgcatcaatgacatgctgcaccatgggtttacccgccagcgtgtgcagcactttaggaatatcggaatacatgcgtgtgcctttacctgcggcaaggatcactacgctcatagcactatttaacatacgcgtcctgactgtaatttgagaacgaatttatactgtttcacgttgaaaatactacatttttttcatcgtaaaatggaagaaggataaaacgctcaccgggataaaatccccgcctgctaatgaatcattttcgttcattaccgcgcctcttgtctcctgaaaagtaaaaacacccgcgtattggcaacgtagtccgatgtttttgctgtttttttactccataaataaagaagataacgtaataaagcgcaggggagtcagaaaagcaaaaaccagcgacagaggccgctggttttccgttgcgcgtattttttacttaattacgcgacataaaaatccgcaaaatataccagaacatggtcgcgatagaagcaaacagatgtaatgccgcgccagcagggcgatcggtagggtaatggtgaataatgttagaagtatcgtaaagtataaacccggcgcacagcagtaccattagcgcagaaaaccagacgcccagcgagaagccgcagatgacgctggcaataatcgcgccaaaagcaatgaacccagccatagtcagaaacgagcgcagaaaagaaaagtctttttttatagaaaaagcggtaaacgtcaggccgccgaccagcaacagagtcgttattgccgccgcgccaatgctcgacgggttaatatacgccgccaccgttaacaggggggcaaaaatcagggattctgccaacacataaatccccagcccgataagttgcgtttgattattccccgcattatccgccagacgggtcgccagcattcccaccagcataaaagcgccgagaacaaccaaccagctatatcttccaccagccagcagcacatcaagcgcatactccccgacccctataaaactccacgccgcgctcaatacgataaaaccgacgatggcgacggcgagatgaagataagcacgacgaataaaggtagtacgatcaatccttgagtcgggttgtggacccgcaaaggatggctgaaatgacatagtaataatccctcattttatgcaataaaaacgcatccattcctcccttcttcgcacaatgtgcagatgccaatgacagaaagaaggatttaatgaaaacagcgctgtcgctgaaaacgcgtcgccttcagccgcttgtttttgtcgttgctagtttatcgaataaaaattgagaggataaaaaaaaaccagtccgcaatcagactggttttatgctttcaagccggtgttacatcgcttttttggtcaactcgataacgcgcagtttagcgatcgctttggccagttccgcagacgcctgagcgtaatccacgtcaccgtgcgagctcttaatgtgctcttcggctttacgcttcgcttccagggctcgcgcttcgtcgagatcctgaccgcgaatcgcggtatccgccagaacggtcacgctgccaggctgcacttccagaatgccgccggacagatagataaactcttcatgaccgtgctgcttaacgatgcgaatcataccaggcttaatggcggtgagtagcggcgcgtgccccgggtaaatccccagttcgccttcgctacccgtaacctggattttctcgaccagaccggagaacatttgttgctccgcgctgacgacatccaggtggtaagtcattgccatatcaccctccgattaaggcgttaaagttttttggctttttccacggcttcgtcgatggaaccgaccatgtagaacgcctgctccggcaggtgatcgtattcgccttccatgatgcctttaaagccacggatggtgtctttcagggagacgtatttgcccggagaaccggtaaatacttccgccacgaagaacggctgggacaggaagcgctgaattttacgcgcgcgagctaccaccagtttatcttcttcagacagttcatccataccgaggatggcgatgatgtctttcagttcctgataacgctgcaggatggactgaacgccacgcgcggtgtcgtagtgttcctgaccaacaaccagcggatccagctgacggctggtggagtccagcgggtcaacggccgggtagatacccagggatgcgatctgacggctcagtaccacggttgcatctaagtgcgcaaaggtggtggctggagacgggtcagtcaagtcatccgccggtacgtataccgcctgtacggaggtgatagaaccggttttggtggaggtgatacgttcctgcagaacgcccatctcttccgccagagtcggctggtaacctactgcggaaggcatacggcccagcagtgcggatacttccgtaccggccagggtgtaacgatagatgttatcgacgaacagcagtacgtcacgaccttcgtcacggaatttctccgccatggtcagaccggtcaatgcaacgcgcagacggtttcccggcggctcgttcatctggccatacaccagggatactttatcgataacgttggagtcggtcatttcgtggtagaagtcgttaccctcacgagtacgttcccctacgcccgcaaacactgagtaaccggagtgctcgatcgcgatgttacggataagctccatcatgtttacggttttacctacacccgcaccaccgaacagaccgactttaccgcccttcgcgaacggacacatcaggtcgataactttgataccggtttccagcagttcctgagagtttgacaactcttcgtaggaaggcgctgcgcggtgaatcgcccaacgctcttcttcgccgatctcgcctttcatgtcgaccggttcgcccaggacgttcatgatacgacccagcgtagctttacctaccgggacttcgatcgggtgttcgagatcttttacatccagaccgcgacgcagaccgtcagaagaccccatcgcgatggtacgcacaataccgccgccaagctgctgctgaacttccagcaccagcttctcattaccattctgcacctcaagggcatcgtacacgcgtggtacggcatcctgagggaactcgacgtcgaccacggcgccgattacctggacaatctttccagtagccatcttaaatcctctacgaaataacctggttaaaccgcggcggcccccgagacgatctcggtgagttcctgagtaatgctggcctgacgagctttgttgtataccaactgcagctctttaatcaggctgccgccattatcggttgcggctttcatcgccaccattcgtgcggcctgctcgctggccaggttttctaccacgccctgataaacctgagactccacataacgacgcaggagagtatccagcagcgctttcgggtctggttcatacaggtaatcccaggctttacgcttcagatcatcatcttctgacgccggcagcggcagcagttgagtgatcgtcggcacctgagacatggtgttaataaatttgttgctgacaatgtaaagcttgtccagacggccttcgtcgtaggcctgcaacatcactttaaccggaccgatcagttcggacagagaagggttatcccccatacctgtcacctgagcgacaacgttgccgcctacggaattaaagaatgacacgcccttagagccgatcattgcgagttcgcactgaacgcctttatcggaccatgccttcatatccgccagcagctttttgaacaggttaatgttcaagccaccgcacaaaccacggtcggtcgacactaccaggtagcccacgcgtttaacgtcgcgctcttccaggtaggggtgcttatattccagattaccgttcgcaaggtgaccaatcactttgcgcatggtctctgcataaggacggctggccgccatgcgatcctgcgatttacgcattttggaagcggcgaccatctccatcgctttagtgatcttttgcgtgttctggacgcttgcgatcttactacgtatctcttttgcgccggccatgagcttctcctcaatgccttacggcctgccctaaggcaagccgccagacgttaccaggactgggttgctttgaaggaatcgaggatgcctttcagcttgccttcgatttcgtcgttatagccaccggactggttgatctcttgcatcagcggagcgtgatcacggtcgacgtaagccagcagtgcggcttcgaagctaccgattttcgccagttcgacatccgccagataaccacgttctgctgcgaacagaaccagagactgctgcgcgacggacatcggcgcatactgtttctgtttcagcagttcggtcactttctgaccgtggtcaagctgtttacgggtggcatcgtcaaggtcggatgcaaactgagagaacgccgccagttcacgatactgcgccagcgcggtacgaataccaccggacagttttttcatgatcttggtctgggctgcgccacctacacgggataccgagatacccgggttaaccgcaggacggataccggcgttaaacaggttagattccaggaagatctgaccatcggtaatggaaattacgttggtcggaacgaacgcggaaacgtcacctgcctgcgtttcgataatcggcagcgcagtcagtgaaccggttttccctttcacttcacctttagtgaaggcttcgacgtagtcggcgttaacacgcgcagcacgctccagcagacgagagtggaggtagaatacgtcgcccgggaatgcttcacgtcctggcggacgacggagcagcagggagatctgacggtaagcaacagcctgtttagacaggtcatcgtaaatgatcagcgcatcttcgccgcggtcacggaagtattcgcccattgcgcaaccggcatacggcgccagatattgcagcgcagcggattcggacgcggtcgccaccacaacaatggtgttagccagcgcgccgtgctcttccagtttacgcaccacgttagagatggtggacgctttctggccgatagcgacatagatacatttgatgccggagtcgcgctggttgatgatggcgtcgatagccagcgcggttttaccggtctgacggtcaccgatgatcagttcacgctgaccacgaccgattgggatcatggagtcaacggctttatagccggtctgcaccggctgatcgacagactgacgatcgataacgcccggcgcaatcgcttcaacggcagagaagccgtcattatcaaccggacctttaccgtcaattggcgcacccagggtgtttaccacacgtcccagcaggccgcggccaaccggaacttccaggatacgacccgtacatttaaccttcatgccttcggcaaggtcagcgtatggacccatgactaccgcacccacggagtcgcgctccaggttcagtgcgatagcgtaacggttacccggcagggagatcatttcaccctgcatacaatcggccaggccgtgaatgcggataacaccgtcactgacagaaacaatagtaccttcgttgtgagcttcgctcaccacattgaactgagcaatgcgctgcttgatcagttcgctgatttcggtggaattcagttgcatgctccagtccccttaagactgcaagacgtctgcaaggcgctcaagacggccgcgtacgctgccatcaatgaccatatcacccgcccggatgataacgcctgccattacagacttatcgattttgcaattcagcttcactttgcgtgacagacgtttttccatcgcggcgctgattttcgaaagctgctcttcactcaatgcggttgccgacgtaacttctacctcggaggtagcttcactggcggcacgcagatgaataaactgctccagaacatccgggagcgcgttcagacgattattttcagccatcacccgaatcaggttctgaccgttttcgtctaactgctcaccgcagactgcgataaacgactcagcgagcgtttccggcgccagcgcgccagagagaagctctgccatttgttcgttcttggttacctcggcggcaaacgccagcatatcctgccagcgctctacactttggtgttcaacggcaaagtcaaaagctgctttggcgtaggggcgagctaccgtaacaaattcagacatcagcccctccctccttacagttcagcgacaagtttatccacgatgtcgctgttagcagcttcatccacggaacgttcgatgatcttctcggcgccagcaacagccaggatagcaacttgcttacgcagctcttcacgggcgcgtttacgctcggcttcaatttccgcctgcgcctgcgccacgattttagtacgttcctgctctgcttcagttttggcttcgtccaggatctgagcgcggcgtttgtttgcctgctcgatgattacctgagcttccgctttcgcttttttcagctggtcggtcgcgctggcctttgcaaggtcaagatccttatgtgctcgttcagcagaagcgagaccgtcagcaatttctttctgacgtttctcgatggctgccattaacggcggccatacgtacttcatgcaaaaccagacaaagagaataaacgcgatggcctggccgaggattgttgcgttaagattcacagcacaatgcctctatctagttaaccttctgatattgctcttaattcaagcaacgcttactacgcgacagcgaacatcacgtacagacccagacctacagcgatcatcgggatagcatccaccagacccataacgataaagaactgagtacgcagcagaggaatcagatcaggttgacgcgccgcgccttccaggaatttacccccgaggatgccgataccgatcgcagcaccgattgccgccagacccatcatcacagcggcagccatgtacagcagatccatattcaggttttccatgacagtctccagtttgtttcagttaaaacgtagtagtgttggtaaattaatgctcttcggacgccatcgacagatagacaatcgtcagaaccatgaaaatgaaggcttgcagcgtaataatcaggatgtggaaaatggcccacggcacattcagaatccactgtgaccaccacggcaacagaccagcaatcagaatgaaaatcagctcaccggcatacatgttgccgaacagtcgcagaccgagagaaaccggtttggacagcagacttaccccttcaaggattaagttgacaggaatgaacgcccagtgattgaacggctgcagcgtcaactcttttgcgaagccgccgatgcctttcattttgatgctgtagaacagaataaggatgaatacgcccagcgccatcgacagggtgatgttgacgtcagcagacggcaccacgcgcgttgccggcagacccagccaatgctcagcgatatacggcagcaggtcgataggcagtaagtccatcaggttcataaggaatacccagacgaaaatcgtcagggccagcggcgcaatcagcttgcttttgccatggtacatgtctttgacgctgccatgcacaaagccgactatcagctcaatcgcggtctgaaacttgcctggcacgccgctggtcgcttttttagcaacgctacggaacatcaccagaaacaacagacccagcaccaccgagaagaacatggagtcaatattgagcgtccagaaggtggctggggggttctgcggatccaccagcgagaaagtacgcaggtccaactgaaggttattcagatggtgtcctatgtattcctgcggcgtcatattttctgaagccatgatgccttttaccctttgttgttaattacagccggcgccagtatctgaaccaccagcaccaaaacccacgtaacgatcagcggcaaaaacaccgcctttaaaaccgccaacgccaccaccagtaaaaccagcatcgctaacaccttgaaggcttcaccgaaggcgaaagtccaggacacgcggcccttagcaggtgtatgcgcctggtgacgccaggcaaatatcataaacaacatattaggcagtgccactgccaatcccccacatactgcggagatgccccagaaggggtctttgaggcaaaacagcaatccacttgctattaccgccagaaactgaatgaacagaagcttacgagcaacgtttcgactcacgagcgacacagacatcacgtttttactcctgctcacttcgaggtatgccgcgtgtcgtataaaacgttctttaagacttagagtcaagcatcaaaaagcggtcaaattatacggtgcgcccccgtgatttcaaacaataagtagccaaaaggtgaataaatgtttaaatatttttctctggcccgcatttttaacttttagccaaagtgtgaacgatcgtacaaaactgcaaatagcgcgaaaacactggcgataaagcgtgcaccagatcacacattaaacatattcatgcttacgcaattcatttacgtgtcaattcatgccttttcatctttttgatatttaagcgtaaaaccaggtactgttttaaaaataccagcttacaccttaaaaacgccccattgacatttataataaaaatttaacaagcaaaagtgatttttcgattcgatttttagcagactgatatttacaaagttgattactctctgttttaacaaaagaagcgacgttgtcatgttgaaacgaaaccgtaaatccagagttaaatgtaacaacgctgaaatgcgttatacctgtcgatttttaacacaagccgcgtcgttttttttctattttttttgataaaaattaaactttgtttgacttaataatcaccagatgccgctcgccttccagttgcggaacgcgtaatttttcaacagattcgacgctaaaattgtcaggtagtgaggcaatttcatcccctggcaattgcccttttaaggcataaaaacgccctttctctcccggcagatggtggcaccagctcaccatatcattcaacgatgcgaaagcgcggctgataacgccatcaaacggcggttcggagggataggcttcaacgcggctttgaaccggcgtgatgttttccagtttcagttcgtgctggacctgacgcagaaaacgtacccgcttgcccaggctgtcgagtaaggtgaaatgcgcgtcagggagaacaatagccagcgggatgcccggcagccccggtcctgttcctacgtcgataaaacgctgtccctgaagatacggcgcaacgactatgctgtcgagaatatggcgtaccaacatttcgttgggatcccgcactgacgtcaggttgtatgctttgttccatttgtgcagcatatcaacgtaggcgaccagcagcgttttctggtgatcggtaagagaaataccggcatcagccagcagacgagagagtttgttgagcacggtcattacctgttaataatcaaatgcccgatgcgctttcgcttatcgggcctacaaatttgtagggcgggcaagcgaagcgcccccgccaaattagtgttatcaagcgctacgacgcagcataccttgttttttcagccataccagcagaatggagattgccgctggcgtaacgccggagatacgcgatgcctggccgatagacgccggtttatgatcgttcagcttggcgataacttcgttcgacagaccggaaacctgacgataatccagcgtggcaggtagcaacgtattctcgttacgtagttgtttttcaatctcatcctgctggcgagcgatatagccttcgtatttgacctggatttccacctgctcagcggcttgctcatcttcaagcgcaggcgcgaatgcggcaagcgaagtgagctgcgcgtaggtcatttccggacgacgcaacagatcttcgccgctggcctcacgggagagaggcgtggtcaaatgcgcattcacttcatcggcggattccgcagacggcgttacccatgtcgatttcagccgctgacgttcgcgttcgatattttccagcttctcgttgaagcgcgcccagcgttcatcatccaccagacccagctcgcggcccatttcagtcagacgcagatcggcattgtcctcacgtagcatcagacgatattcggcacgggaggtaaacatgcgatacggctctttggtgcccagcgtacagagatcgtccaccagcacgccgagataagcctgagaacgcgcaggcgcccagccctctttgtcggcggaaagacgcgcggcattcagaccagcgagcaagccctgcgccgcagcctcttcatagccggtagtaccgttgatttgaccagcaaagaacaggccgtgaataaatttactttccagagtcggtttcagatcgcgcgggtcgaagaaatcgtactcaatcgcgtaaccagggcgaacgatcttcgcgttctccataccctgcatggaacggacaatctgcatctgcacgtcaaacggcaggctggtggagataccgttagggtaaatctcgttagaggtcagtccttccggctcaaggaagatctgatgctggttacgatcggcaaaacgcatcaccttgtcttcgatcgaaggacagtagcgtgggccgatcccttcgatcacgccagcgtacattgggctacgatcgaggttattacgaatcacgtcatgggttttctcattggtatgcgtgatgtaacacggcacctgttgcggatgctgagaagcattccccataaacgagaaaaccggcatcgggttatcgccatgctgttgagccaacacgctgaaatcgatagtacgcgcatcaatacgcggcggtgtgccggttttcaggcggctgacgcgtagcggaagctcacgcagacggcgagacagcgggatggatggcggatcgccagcacgaccgccgctgtagttatccagaccaatatgaattttgccatccaggaaggttccgacggtcagtaccaccgctttcgcgcggaatttgagccccatttgggtcacggcgccgacaacgcgatcgttttcgacaatcagatcttcaacagcttgctggaagatcatcagattcggctgattctccagcgcggtacgcaccgcctggcggtataagactcgatccgcctgagcccgggtagcgcgaacggccggacctttgctggcgtttagtatcctaaactgaatacctgcctgatcgatcgctttcgccatcagaccgccgagcgcatccacctcttttaccagatgtccctttccaataccgccgatcgccgggttgcagctcatctgtcccaacgtgtcaatattgtgtgtcaaaagcagagtctgttgacccatacgcgctgcggccatcgcggcctcagtgcctgcatgacccccgccaataataatgacgtcaaaaggatcctgataaaacatggtaattgcctcgcataacgcggtgtgaaaatggattgaagcccgggcggtggattctactcaactttagccgatggagaaagccccgggatccgggctattaaaaagaagatctttttatttagagatctgttctattgtgatctcttattaggatcgcgccaggctgtggataacccggatcctgtaataaagatcaatgcgttggaaaggatcactagctgtgaatgatcggtgatcgtggtccgtataagctgggatcaaaacgggtacttatacacaactcaaaaagtgaacaacggttattctttggataactaccggttgatccaagctttccaccagatttatccacaatggatcgcacgatctttacacttatttgagtaaattaatccaggatccgagccaaatctccgctggatcttccggaatctcatgttcaaggatgttgatcttcagtgtttccccaacctgttttgcgccagcgcctttcagttccgcttctattttctcaatcgcgccgcaaaacgtgtcgtattctcgactgccaatgccaattgcgccgaaacgtaccgcggaaagatcgggtttctgcgtctgaaggtcttcatagaaaggggtcaggttgtccggaatgtctccggcaccgtgcgttgagctgattatcagccagatcccggaagttgacagatcctctaataacggaccgtgcaccgtttcggttgaaaaaccggcagcttccagcttttccgccagatgttccgcgacgtattcggcgccgcccagggtgctgccgctgataagagtaatgtctgccattgatcgctcgctcaggtaaagaggctgcattgtactctgtgaacgagctgggatctacctgtggaaaaatgtgggattaaaaaagccgatcatggcttgatggtgcgcatgatcgggttctgcaagacgatcagtgtctcagtggactgaatttcatcaattgtttggatcttgttgataagtacgtgctgaagcgcgtcgattgatttgcacatcacttttataaagatgctgtagtgaccggtggtgtaatacgcttccgtcacctcatccaggctttccagccgggccagtgcggagggatagtctttggcgcttttgaggatgatgccaataaagcagcccacatcgtagcccagttgtttagggctgacgtcaatccgtgcgcccgtaatgatcccggcctgcttcattttctcgacgcgaacgtgaatggttccagggctaacgccaaattgtttggccagttcggcgtaggcggtgcgggcatttcccattaaggcgtcaagtatgccgcggtccagattgtcgatctgataattttccatcgctttttcttatgcagattaatgattatctctattttagccattatttttaacgaatcaaaaccgaagttagctttttatctgttgattattgaatagtgctctcgttttgttgcttaatcataggcaacaggacgcaggagtaaaaaaatgaaaaccgcttacattgccaaacaacgtcaaattagcttcgtgaaatcacatttctctcgccagctggaggagcgtctgggtctgattgaggtccaggcgccgatcctgagtcgcgtaggggatggtacgcaggataatttgtccggctgtgaaaaagcggtgcaggtaaaagtgaaagcattgcctgacgcccagttcgaagtggtgcattcactggcgaagtggaaacgtcaaaccctggggcaacatgacttcagcgcgggcgaagggctgtacacgcacatgaaagcccttcgccccgatgaagaccgactctctccgctccactcggtctatgtggatcagtgggactgggagcgtgtcatgggcgatggcgagcgccaattttccaccctgaaaagcacagtagaggctatatgggcaggaattaaggcgacggaagcagaagtgcataaacagtttggtctggcgccgttcctgccagagcaaattcagtttgttcacagtcaggaactgctggcgcgtttcccggatctggatgcgaaagggcgcgaacgcgcgatcgccaaagaacttggcgccgttttcctggtggggatcggcggtaaactgagcgatggccaccgccatgatgtacgcgcgccggattatgatgactggagctccgcatctgagctgggctacgccggtctgaacggcgatatcctggtgtggaacccggtgctggaagatgcgtttgagctttcctctatgggtatccgcgtagatgccgatacgctgatgcgccagctggcgttgaccggtgatgaagatcgtctgcaactggagtggcatcaggcgctgctgcgcggcgaaatgccgcagaccatcggcggcgggattgggcagtcgcgtctgacgatgttgctgctgcaattgccgcatattggtcaggtacagtgcggcgtatggcccgcgcaggttcgcgaaagcattcctgctattttataagccgttagcgccgccagcgtctcagcaggcggcttcgcatcccggtgtcaaagcgccagatatgatcgaaaatgcgcatgatgccgggtttgccgtgcgccgacatcgccaccgcatggaatcgatgctggtgaagacgctgcaactctcccactttgctcaccacgtcatccggcaagcgctgggcgataaaatccgaaatgaccaccgcatcggcatcaaaccattcccgtccctgcattctttcaataatggcgcgaaaacagctggcgatatccgtgccgccgcgaaaacgttgacttaaaaagcggatggcctgctcgataccttccgggccggagagttcatagcgcacaacgtcagtggaaaacagcataataaagcagcggcggttatccgccagcgcaacgcgcatcaacgccaggcagaacgcttttgcgcactgctcgttaaatcctcccatcgagcctgaagtatcgacgcagacaataaacggtccgcgcggctgctcgtcgacatcctggtgtactaccggccgttcggtcactttctcacgccacgcttcgccatgcaggcgataggtgaggagctgtttttccactaaccggcggtaaaattcatattccagctcggtgatgccgagcgtcgccagctctggcggcaacaggcgcagaatatcatcgccttgctgaataccgtcaacctgctccggcaccgttgcgggttcgcgtaccagtgtacgaaaggtttccatcggcgcgtcttttttcggtaccgatttggcttcccgcgaacgtcccagttgttccgccagttgcattagctccggctgggcggcgagaaattcgccgtattttacgatcagttgataatcaccacgtttaagctggcccgcgctcatatcccacaggcggcctgcggcattatcattttccgccagcgtcggttccagttgcccgctcagcgtcatccgttcctgaacgtcactcagcaactgctcgcgctcttcttccagtagttgttggtttaacgtggtggcctgcacgaccagacttaaccgccagcgttgcaaaaaaagcgtgtgtagcgcaggggtaaaggtactgttgctctccgtcaactgcttcgcctgcgcggcatacggtgaatgcaggcggtgaagcaacgccagtatttgcggcagttgcacgatgaactgtggggtagagagaagttggctttgctgataacacatgacctcttccgtgagttccggcggaacgcgtgcgtctttaagacggctgcgtagcgcttcccgccagcgcgggagatcggcggtcacggcgttttttaaacgcggaaacttttcaaagaaaatgaccagttgtggggaagccagtagcgcgaggatcatctcttcgaccattccctcttcgctgacggccagcatggtatttagcgtatccagcgtcagcattgtttcgcctggcggatctgttctcctacatcctgcaggctggcctcaatgcgccctaaccagtcgctgtgaataaacaggcaatgttgctgttcgctgaagcgggtatgctgctggcgccagtcgttttctaacgtttccagctgctgtttgatctccgcaggcatactgtcttcagccgttcccggtaacgccagacgggtaccttgtagactgatgtcgcgcaccaccagatgttgagcgttatcgacttccatattcagcgtttgggcaaagccgatcccgttcagtttgccgcggatctcgccgcctttggtcagccaaagttccagcgcgctgcggtcaaaggtaatatggatcacttccatatcatgcaatttgagcggtttttgtagcaataacgtcaacgttgacgcactggcttccggcggtaaagtgtaatgcgggcgacggctgaacataccgccttctttaatgacggtgaaggcggttttatcgctttgctgttgctgcaactgaaggcgacgctggacgataccgccgaggcgagtcagcatggcctgctgctgccaggcgtgtccggtcatcaatatttccagttgctgttgcatgagattcagactctgcgcgtcataccacaagcaatcttttagcaggataaggtcaatcggcgcaaccgcgtcgcgtccgctaaagaaggcgctggcctgtaacaggcggatggctttcttccagcgacggtcggagacataaggcgcattcggcaaattatccagctgttggcgcagagtaaatatcagctcaaagaccggatcagggagtgaaatcgcgccgatatccttttgccactgttgatattcttcgtcgctaacctgtaacgaggcaggtaccgggttatcactttcatcctgctgactgaccagcatggagcggaaattggctttatcctgaactttatccagccacaggcgaatcaacattcggtcgtacaacgcttccaggctgctgtccgcttcgggcagttcgttagaggccgccaccagcagccgcatcggaattttttcctcaaatgcgccgttgcggaaatggcgttcgttaatggcggtcagcaatgtgttcaggatagctggcccggctttccagatttcatccagaaaaacgatttcggcttcgggaaggtagccggtcgttaagcgttcatagcgaccttcatctttcagcgcctgaatagagagcgggccaaaaacctcttccggcgtggaaaagcgtgtcatcagatattcaaaagcgcgggcgcgctggaaagcaaacttcaggcggcgggcaatcagactcttggcgataccgggcgggcccaacaaaaagacgctctcaccgcttaacgccgccagtaggcaaaggcgtatggcatgactacgttcatacagccccttctcaagggcgctgctcagacgggaaattctttccgctaataaatgtgggtgagccataataaagaggcgtcctttcgacaaatggatcatgctaattgcgagtatagacgtttcaccaccggggctgtaatcgtctgacgcgctgtttatttttctttgagccaggttaatctggcttcatttaggggtacgattttatgattaatcgtgcatactgtgcgcttttttgtgggccaagggactaagcacacatttcatatctatacactcattcattcaaactacatcaaggcggcaaaggagtgaatcccctggcactgacttaaacgtgtgactggggtaagcgaatgcagccgacaaggaggtagggtgaagggtgacgtgtataaacgaaagatgagtctatgagcactgataataagcaatcgttgcctgcgattaccctcgcagctattggggttgtctacggtgatattggtaccagcccgctttatacgcttcgtgaatgtttgtccggtcagtttggttttggcgttgaacgagatgccgtatttggttttctgtcgctgatcttctggctactcatctttgtggtttccatcaaatatctcaccttcgtgatgcgcgccgataacgcgggtgaaggtggaattttgacgctgatgtcgcttgccgggcgtaatacctcggcgcgcaccacatccatgttagttatcatgggactgataggcggcagctttttctatggcgaagtggtgattacgccggcgatttcggtgatgtcggcgattgaaggcctggagattgtcgcgccgcagctggatacctggattgtcccgctctccattattgtgctgactctgttgtttatgattcagaagcacggtacgggaatggtagggaaactctttgcgccgatcatgctgacctggtttttaatcctggcggtacttggcctgcgcagtattatcgccaatcccgaagtgttacatgcgctgaatcctgtctgggcggtacgttttttccttgaatataaaaccgtatcatttattgcgttgggcgcggtggtgctgtcgattaccggcgtagaggcgttgtacgccgatatgggacacttcggtaagttcccgattcgcctggcgtggtttaccgtggtattgccgtcgttagtactgaactactttggtcagggcgcattgctacttaagcatccggaagcgattaaaaaccccttcttcctgttggcgccggactgggcgttaattccgctgctgattctggccgcgctggcgacggtgatcgcctcccaggcggtcatttccggcgtcttttcgctgacgcgtcaggccgtgcgtcttggctatttgtcgccaatgcgcattatccatacctccgagatggagtccggtcagatctatatccctttcgttaactggctgctttatttcgcggtcgtggttgttattgttagctttgagcactccagcaacctggcggcggcctatggtatcgccgtgaccggcacgatggtgctgacgtctattctttctacgaccgtggcgcgtaagaactggcactggaacaaatattttgtcgcgctgatcctcatcgcattcctgtgcgtggatatcccgctgttctcggctaacctcgataaattgttgtccggcggttggctgccgctgagcctgggtctgatcatgttcacgatcatgaccacctggaagagcgagcgtttccgtctgttgcgtcgtatgcatgaacacggtaattcgctggaagcgatgattgcttcactggagaagtcaccgccggttcgggtgccgggtactgccgtatacatgtcgcgcgcgctcagtgtgatcccttttgctttattgcataacctgaagcacaacaaagtgttgcatgagcgcgtaatcttactgacgttgcgtacggaagatgcgccttatgtgcataacgttcgccgggtgcagattgagcagttgtctccgacattctggcgcgtggtggccagctacggctggcgcgaaacgccaaacgttgaagaggtgttccaccgctgcggtctggaaggccttagctgtcggatgatggaaacgtcgttctttatgtcgcacgagtcgttgattgtcggcaaacgcccgtggtatttgcgtctgcgtggcaagctgtatttgttgttgcaacgcaacgccctgcgcgcgccggatcagttcgagatcccgcctaaccgcgtgattgagttaggtacgcaggtcgagatttaacctcccatcaacatgccgggggccgcgttggcttacccggcctggccaatccgtagattcccacaagataatcgcctgatttccgctagcgaaacgtttcgacggcgatcacaattctgttacgtcatgatggttttatgaacacatccggggttacactgcggccagcgaaacgtttcgctagtggagcagaaaaatgaagaaaggcaccgtactcaactctgaaatctcgtcggtcatttcccgtctggggcatactgatactctggtagtctgtgatgcgggtttacccatcccgaatagcaccgcgcgtatcgatatggcactaacccagggcgtaccttcttttatgcaggtggtggatgtcgtgacccgggaaatgcaggttgaggcggcgattcttgcaacggaaatcaaacaacagaatccgcagctccacgaaacgttgctcactcaccttgagcaactgcagcaacaccagggaaacaccataaaaattagttatacgacacacgaacaattcaaaaaattgactgcagacagtcaggcggtgattcgcagcggggagtgttccccgtatgcgaacgtcattctttgcgctggcgtcactttctgaggccgctatggacgcattactgcaactcaaagggatcgataaagcgttccccggcgtgaaggctctctccggcgccgcgttaaacgtttatcctggccgcgttatggcgctggtgggggaaaacggcgccggaaaatccaccatgatgaaagtattaaccggcatctatacgcgagatgcgggatcgttgttatggctgggtaaagagaccacctttaatgggcctaaatcgtctcaggaagccgggatcggcattattcatcaggaactgaacctgatcccgcagttgaccattgcggaaaacatcttcctgggccgtgagtttgtgaatcgctttggcaaaatcgactggaaaaagatgtatgccgaagccgaccacctcttagccaaactcaatctgcgttttaagagcgataagctggtgggcgaactctctatcggcgatcagcaaatggtggaaatcgccaaagtgctgagcttcgaatccaaagtcatcattatggatgaaccgaccgatgcgctgaccgacactgaaaccgactctctgttccgcgttatccgcgaattaaaatcgcaggggcgcggcattgtctatatctcccaccgtatgaaagagatcttcgaaatttgcgatgacgtgacggtcttccgcgatgggcaatttatcgccgagcgtgaagtggccacgttgaccgaagattctcttatcgaaatgatggtgggacgtaagctggaagatcagtacccgcatctggataacgcgccgggtgagattcgcctcaaggtcgataatctgtgcggaccgggcgtgaatgatgtctcttttgtgctgcgaaaaggcgagattcttggcatctccggcctgatgggcgccggtcgcaccgagctgatgaaagtattgtacggcgcgatgccgcgaaccagcggttatgtgacgctcgatggacacgaagtggtgacgcgctctccgcaggacgggctggccaatggcatcgtttatatctctgaagaccgtaagcgcgatggactggtgctcggcatgtcagttaaagagaatatgtcgctgacggcgctggactatttcagccgcgctggcggaagcctgaaacacaaagatgagcagcaggcggtgggggattttatccgtctgttcaacgtcaagacgccttcaatggaacaggcgataggcctgctttccggtggtaatcagcaaaaagtggcgattgcccgcgggttgatgacgcgcccgaaagtgctcattctcgacgagccgacccgcggcgtggacgtcggcgccaagaaagagatttaccagcttatcaaccagtttaaggccgacggcctgagcatcattctggtctcatctgagatgccagaagtattaggcatgagcgatcgcatcatcgtcatgcatgaagggcatctcagcggtgaatttactcgcgagcaggccacccaggaagtgttaatggctgccgcagtgggcaagcttaatcgcgtgaatcaggagtaaaaaagatgacaacccaggctgtttctggtcgccgttatttcactaaagcgtggcttcttgagcagaagtcgctcattgccctgctggtgttgatcgcgattgtttcgacgttgagccccaacttttttaccgttaataatctgttcaatattcttcaacagacctccgttaacgccattatggcggtggggatgacgttggtgattctgacatcggggatcgatctgtccgtcggttccctgctggcgctcaccggtgcggttgccgcttcaatcgtcggcgttgaagtgaatgcgctggtcgcggttgccgccgcgctggcgctgggcgctgcgattggcgccgtcactggcgttatcgtcgcgaagggccgcgtacaggcgtttatcgctacgctggtgatgatgctgctactgcgtggcgtgacgatggtttacaccgacggtagcccggtcaacaccggctttaccgataacgccgatctgtttggctggttcggtatcggtcgtccgctgggcgttcctacgccggtctggatcatggctatcgtctttatcgccgcctggtatatgctgcatcacactcgtctgggacgctatatctacgcgctgggcggtaacgaagcggcgacgcgtctgtctggcattagcgtgagcaaagtgaaaattatcgtctattcactttgcggcctgacagcatcgctggcgggcatcattgaagtggcgcgcctctcttccgcgcagccgacggcgggtaccggctatgagctggatgctattgccgccgtggtgctgggcggcaccagccttgcaggtggtaaagggcgcattgttgggacattgatcggcgcattgattctcggcttccttaataatggtttgaatttgttaggtgtttcctcctattaccagatgatcgtcaaagcggtggtgattttgctggcggtactggtagacaacaaaaagcagtaacaacgactacaggacatctgaaatatgaacatgaaaaaactggctaccctggtatctgctgttgcgctgagcgccaccgtgagcgcgaatgcaatggcgaaagacaccattgcgctggtgatctctaccctcaataatcccttcttcgtgtcgttaaaagacggggcgcaaaaagaggcggataaactgggttataacctggtggtgctggactcccagaacaaccctgccaaagagctggcgaacgtgcaggatttaaccgttcgcgggaccaaaattctgctgatcaacccgactgactccgatgcggtgggtaacgcggtgaagatggcgaaccaggcgaagattccggttatcacgcttgaccgccaggcaaccaaaggcgatgtcgtcagccatatcgcgtctgataacgtgctgggcggtaagatcgctggcgactatatcgcgaaaaaagctggcgaaggcgccaaagtgattgagttgcaaggcattgccggaacatctgcggcgcgtgagcgtggcgaaggtttccagcaggcggtagccgcccacaaatttaatgtcctggccagccagcctgctgatttcgaccgtactaagggtctgaacgtcatgcagaacctgctaaccgcgcatccggatgttcaggctgtcttcgcccagaacgatgaaatggcgctgggcgcactgcgcgcactgcaaactgccggtaaagcagatgtgatggtggttggatttgacggtacgccggatggcgaaaaggccgtaaaagatggcaaactggcagcgactatcgctcagttaccggatcaaatcggcgccaaaggcgttgaagtggcggataaggtgttgaaaggcgaaaaagttcaggccaaatatccggttgacctgaaactggtcatcaagcagtaataaacgacacgggtcaactatggcctgatggcgacagaaatacgcgagcctccgctgaggtgaacgtaaaaaaaagaaaagcagggcacgcgccaccctaaccggtggcgcactttgacgtggaaccccgaatatgaaaaccgcaggtaatctcatcgtccttggcagcattaatgccgatcatatccttaatcttgagtccttccctaccccgggtgaaacggtaaccggtagccattatcaggtcgcgtttggtgggaaaggcgcgaatcaggcggttgctgcgggacgtagcggggcaaatattgcgtttatcgcctgcacgggcgatgacgatattggcgacagtattcgtaaacaattagtcagcgatcgtattgatatcgcgccagttagcgttattaaaggcgagtctaccggggtggcgctgattttcgttaatggcgaaggcgagaacgtcatcggtattcatgccggagcgaatgccgcgttatcgccggcgttggttgatgcgcagcgtgaacgtatcgcgcaggcggatgcgttactgatgcaactggaatcgccgctggaaagcgtactggcggcggcgaaaatcgcccatcaacatcatactactgttgcgcttaatccggcgcctgcccgtgagttaccggatgaactgctggcgctggtggacatcatcacgccaaatgaaacggaagctgaaaagctgacgggcgtgcgtgtggaaaatgacgacgatgccgcgaaagctgcgcaggttttgcatgataaaggcattcgaaccgtattaattaccttaggaagccgtggcgtctgggccagcgtagacggcgagggccgccgcgttcctggatttagcgttgaggctgtcgataccattgctgccggagatacgtttaacggcgcctttatcaccgcgatactggaggagacgccgttgccggaagcgattcgctttgcccatgccgccgccgcgattgccgtaacgcgtaaaggcgcgcaaccttccgttccgtggcgcgaagagatagaagcgtttttacatcagcaggggtaacgcttggctactatgaaagatgttgcccgcctggcgggagtctctacatcgacggtctctcacgttattaacaaagatcgctttgtgagtgagacgataaccgaaaaagttgaagcggcgattaaatcgctcaactatgcgccttctgcgctggcgcgaagcctcaagttaaaccagacccgcacgattggtatgctaattaccgccagtaccaaccctttttattccgaactggtgcgcggcgttgagcgaagctgttttgagcgcggttatagtctggtgctgtgcaataccgaaggcgacgagcaacggatgaaccgcaacctggagacgctgatgcaaaaacgggtagacggtttactgctgctgtgtaccgaaacgcatcagccttctcgtgaaatcatggagcgttatccgtctattcctaccgtcatgatggactggtcgccgtttgatggtgagggcgatagcgatctcattcaggataattcgttgctaggcggcgatcttgctacccaataccttatcgataaaggatttacccgaatagcctgtattaccggcccgctggacaaaacgccagcgcgtttacggctggaagggtatcgggcggcgatgaaacgcgcagggctggctattccgcaaggctatgagatcaccggcgattttgaatttggcggcggctttgacgccatgcaggcgttactcgcccatcaacagcgaccgcaagcggtttttaccggaaacgatgcgatggctgtcggcgcctatcaggcgctatatcaggcggggcttcgtattccgcaggatatggcagtcattggctatgatgatattgagctggcgcgctatatgacgccgccgctgacgactatccatcagccgaaagatgaattgggcgagctggctattgatgtgttgattcatcggatggcgcagcccgccttgcaacaacagcgacttcagcttactccggttttgacggtgcgtgggtcggtttagatttatgccgttctttaatcagattgttgccgtctttggctcttagcagcataaacatcagcgcggacacgatagtgatcgcccccatcgtgataaaggtatagtggaactgttccacggtactggtgcccgcaaaaccttcataaatacgtaacaccgccgcgctgatcgccacgcctaaactgatagacaattgctgcgtaaccgccagaacgctgttgccgctgctggcattatcgtccgtcagatccgcaagagtaatcgtattcattgccgtaaattgagtggacatcgccattccaagaatgaatagcggcagcacgagcatccagatcggcatggcgggagattgaaacgaaaactgggcaatcatcagaccgataaataccgtaatgccgaccagagtcttccggtatcccaaacgtcgtaaaacctgcgttacggtcgatttcgcgataatagaacccaaagccgtcggcgccatcatgcagccggcgatcagagccgggtagccaaaaccaacctgtagcattaacggcatcaaaaaaggtacgcagcctgtccccagacgcgtggcgaggttgccggcaataccgacggaaaatgtgcgtgtcttaaacagcgatagtgatattaacggtgtcggatgacggcgggcgtggcggatataggccaatagtagaacgatactgcaaaaaataatggcggatgcgatccatgtcgccacaatcttttcgccaaacagttccattccgctggaaaataaaaccagacttaacccaaaaagaaagaagccggtcatgtcaaacttgcgacgcggcgtggtgaagttgggcatatatttgcgggcatacagaatgcctgcaacaccaatgggaatattaatcaggaagatccagtgccagcttgcccaggtcaccagtacgccgcctaataccggccccagaatcggacctaccagccccggcatagtgacaaagttaagaacgggcagcagctcactacgcggataggctcgcaataacgccagccgcgccactggcatcatcatcgctccgccgacgccttgtacgacgcgaaaaataaccaattcagatagtgaactggagagcgcgcaggccagcgagcctaacgtaaacagacttacggcaaccataaaaacgcgacgcgtaccaaagcggtcagccagccagccgcttaccggaattaacatagctactgtcagggtataactgataatagcggactgcatggcgagtggtgaacggttaagactatgcgcaatagccggtaaagcggtattcaaaatggtggcgtctagcgcctgcataaagaaggccatcgccgcgatccacggcaggccagccatactgcgcgcttttttgctggtcattcaatatcctgttaattatctggtctctcattgggcgctattaacaacgcctggcaggcctggaaagcgcgttcgccgtcgccatcagcgatggcatcaacaatggcctggtgcaaatccagctttaccacctcgttataggtgattgaggtaaagtaagtgtgataaaccgaatgaaatagcgtcgcaaaagagattagaaagggattggcgctcatttcgtagatatgctcgtgccacgccatatccacttcaatccagcgttcacgcttaaaatgctttttcagcgcgaccatctcttccattaaggcattaagccgcgctttctgctccggtgtgccaagagtcgccgccagcaggcaggcttgcggctccaggctaatacgcatcaccagaaaatgctctaccacctgatgaaaattttcttccgtcatccaccaggtcagcagctcttgatccagaaagttccagtttccctgcggcatcacccgcgtaccaatgcgcggacgaggtagcaccatacctttagccgtcaacgttttcaccgcttcgcgaactgccgttcgacttacgccgtactgctcgcccagttctatttcgccgggaagaatcgtaccgggggcgtagtcaccctttaatatccgctgcgccagcttttcagccagaacataggatagatttttctgtgcggctaattgttgtgcgcttaaaggcatgaatgttcttcctttctctttcgtttggttattagtatgccacctggaagtgtgattgcagttgcaataacggcaatttgcttattttatggcacgttaagcacgctattgatgaaaaaagagacactcagaaaattattttaaatttcctcttgtcaggcagaaataactccctataatgcgccaccactgacacggaacaacggcacacaggccgccgggtcagcggggttcagaccagaacctcacggagaaaagcgaaaataaacgcttgactctgaagcgggaaagcgtaatatgcacaccccgcgccgctgagaaaaagcgaagcggcactgctctttaacaatttatcagacaatctgtgtgggcactcgaagatacggattcttaacgtcctaggacgaaaaatgaataccaagtctcaagagtgaacacgtaattcattacgaagtttaattcattgagcatcaaacttttaaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacagaagaatccagagatggatttgtgccttcgggaactgtgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaactgttctttgcagtgctcacacagattgtctgatgaaaagtaaatagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactgacttacgagtcacgtttgagatatttgctctttaaaaatctggatcaagctgaaaattgaaacacagaacaacgaaagttgttcgtgagtctctcaaattttcgcaacacgacgatgaatcgaaagaaacatcttcgggttgtgaggttaagcgactaagcgtacacggtggatgccctggcagtcagaggcgatgaagggcgtgctaatctgcgataagcgccggtaaggtgatatgaaccgttataaccggcgatacccgaatggggaaacccagtgtgattcgtcacactatcattaactgaatccataggttaatgaggcgaaccgggggaactgaaacatctaagtaccccgaggaaaagaaatcaaccgagattcccccagtagcggcgagcgaacggggaggagcccagagcctgaatcagcatgtgtgttagtggaagcgtctggaaaggtgcgcgatacagggtgacagccccgtacacaaaagcgcatgtgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacaggtttacctgtgtgactgcgtaccttttgtataatgggtcagcgacttatattctgtagcaaggttaaccgtataggggagccggagggaaaccgagtcttaaccgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaattcatctccgggggtagagcactgtttcggctagggggccatcccggcttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgaacgtatcacccaagacaactttacggagttgacgattgacggagcgaagcgacgtcaaagcgttcattaaagtcgagttggcttagggatacgttcgttgggtaggggagcgttctgtaagcctgtgaaggtgtgtcgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacgggttaatattcccgtacttggtgttactgcgaaggggggacggagaaggctatgttggccgggcgacggttgtcccggtttaagcgtgtaggtgtgtgttccaggtaaatccggttcactttaacactgaggcgtgacgacgaggcactacggtgctgaagcaacaaatgccctgcttccaggaaaagcctctaagcatcaggtaacacgaaatcgtaccccaaaccgacacaggtggtcaggtagagaataccaaggcgcttgagagaactcgggtgaaggaactaggcaaaatggtgccgtaacttcgggagaaggcacgctgacacgtaggtgaagtgatttactcatggagctgaagtcagtcgaagataccagctggctgcaactgtttattaaaaacacagcactgtgcaaacacgaaagtggacgtatacggtgtgacgcctgcccggtgccggaaggttaattgatggggtcagcgtaagcgaagctcctgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgtggacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagatgttttggcggttaagagaagattttcagcactgattcagattacatcagaacgtaaaaacggtctgataacagaatttgcctggcggcactagcgcggtggtcccacctgaccccatgccgaactcagaagtgaaacgccgtagcgccgatggtagtgtggggtctccccatgcgagagtagggaactgccaggcatcaaattaagcagtaaactgatgtaaaaatcagtggttgtaaaagaattcggtggagcggtagttcagttggttagaatacctgcctgtcacgcagggggtcgcgggttcgagtcccgtccgttccgccaccctaattaggggcgtagttcaattggtagagcaccggtctccaaaaccgggtgttgggagttcgagtctctccgcccctgccagaaataatccttagcatctgctaaggatttttttttgcctaaaattacctgattatctgatcaggtaatcgtaagttcccttctttttcttttcatcattttcattgttcatccagcacatccgtttttaacagatcgcagatcagcgagtatttatcgctgttttgcagccaaatagcgtatagtggccgtgaaagcgttgcgctgtcggcaacggtatgtaatccgcccttttcatttgcccagtttacaggaagccagctacagccatttaatgcgctaagctgctgtcgggcgagttcggctgagctggttgttaataccggcacttcatctgctgcgatcagccctgtttcatgctgttggaagtctggtccccactccagccgcagataattgagttctgatttcttacgggcagggctgctgcaatataacgccaaagtgaagtgccctaacagctgactgctgaactcatccattttgggcgcttcggtagtaatgaggagatcaagctggcgttcatgaagttgcttcacaagcgattgccgttgagcgattctggcttcgaactgcaggccgctttgcggctcctgtagttggtacagtcgccccagccaggcgttaagcatacactcccataaagacgcgctggcgccgatggaaaactcgttatggcgtgaggtatgcgccacctctttacgtgccgcctgccacgtattcatcagcgtttccgcatacggtaaaagtttttcgccagccgtggttaaacggatattgtttctgtgccgcgtaaaaaggtttacgcccagttgattctccagttgcctgatacgaaagctcaccgcggattgcgtcaggtaaagtgcttctgcggcccgcccgaaatggcgtgtccggctaacttccaggaaagtttttaacaattccgtatccactgtgctctccacaaaattatttgtcgttatgatttaaatgttttgttttacactctgtcaagcgtaactaatactccgcgccataaatagctcagacaaagaattaggagcgtgcaggatggcggaaagctttacgacgactaatcgatattttgacaataaacattatccacgtggattctctcgtcacggtgatttcacgattaaagaggcacaactgcttgagcgtcatggtcatgcctttaatgatctggatcttggcaagcgtgagcctgtgactgaagaagagaagctgtttgtagcggtatgtcgcggtgaacgcgagccggtaacggatgcagaacgcgtctggtccaagtatatgacgcgtatcaagcgtccaaaacgcttccacaccttgtctggcggcaagccgcaagttgaaggcgcagaagactacaccgaagctgatgattaataaaaagggcgtaatgccctttttttacgccaacagcttttgcaaatgaattaacaacctgtctatcgcccgatagcttaccgcctcctgcaaatgctgacgcgagatctggtcagccagttctatgtcggcaatggttctggcaacttttagtaaacgctgccaggcgcgaatggataatccaagatgcaccagcgtgtcttcaagccagcgggcgtcatcgtgatgcaaaacacaatatttttggatttcgcgaccctccagacgcgcgtttaacttcttctggcgtcggtactgccgttcatgggcggcgatgacccgcttttttaccgtagcgctgctctcaccctttgaggcgtgttggctaagaatcccgggcggtggaagcggtatctcaagcgaaaggtcaaaacgatcaagaaacgggcctgacaaccgattaaggtaacgtagtgtctgttctggcgtgcagcgattatggtttccctgataatgtccggtcgggctgggattcattgcggcgattaactggaacctggcagggtacgttattttcgctctggtacgggataaatgaatttgaccggattctataggttcacgtagcgcatccagtgtgcgtcgttcaaattcaggcaattcatcaaggaacaaaattccgttgtgcgccagcgatatctctcccggggcgggtattgcgccgccgccgaccatagcagtaagtgaggcgctatgatgaggtgagcgaaaggggcgttgctgccatcgtttttgtaccgtatcggcattaaccagactgaggatcgcggcgctttccaacgcctcctcattgcttaatggtggaagaatcccgctcagtcgactggccagcatggttttacccgtacccggcgggccgatcaatagcagattatgtccccctgccgctgtaatctccaggccgcgtttaccctgctcctgaccgatcacatcgcgaagatcggcagttgcggtaggcgatgccatatcctgagctaaaggtctttccagggcgtgtttcccttccagaaaggcgcagacggtttgtagatgatcggcgataaaacatccttctttgcttataagcccaacctccgccgcgttctctgttgcgacgataatatttctgccggccctgatggcttccgttgcacttgatattgcgccaggaacgccgcgtaatgcgcctgtaagcgctaactcacccaccagctcatatgcctcaagattcgacgctgtaagctgctcagacgcggccagaagcgcaacagcaataggcaggtcataccttccaccctctttcggtagatcggctggagcaaggttaatggttatttttttagccggaaattcatatccgctattaataatcgcactacgtacccggtcacgcgcctcttttaccgtggtttccggtaggccaaccatggttaatcccggtaatccattactgatatgcacctctatagtgataggcggcgcattgacgccaagtgcggcgcgggtatgaacaatcgccagtgacataatccctcctgttacgtggattatgcggaatagaagagaaaatcgaattactgactttttgttttttagcgactgcttcctgaattttggcgtcattttcaggtaagaaacatcaaactggaagaacgctcgcagaagcgaaaagaaggaaaacaggatgtagagtgcgccaaaagggggaggaaaacgtgaaaatttttcagttgctaatttttcttataaaaaacaaagtacttttaggcattcacctgcattatctgaaacgtggttaaaaaaatatcttgtgctattggcaaaacctatggtaactctttaggtattccttcgaacaagatgcaagaatagacaaaaatgacagcccttctacgagtgattagcctggtcgtgattagcgtggtggtgattattatcccaccgtgcggggctgcacttggacgaggaaaggcttagaaatcaagccttaacgaactaagacccccgcaccgaaaggtccgggggttttttttggcctgaaaaacttaagcgaggagcagagcgtgaataacagcataaaattctgtttctcaagatttacgacggggatgtaactatgaacggggcacagtgggtggtacatgctttgcgagcgcagggggtgaaaaccgtatttggttatcctggcggcgcaattatgccggtttacgacgcgttgtatgacggtggtgtggagcatttgttgtgccgacacgagcagggtgcggcaatggcggcaatcggttatgcccgttctaccggcaaaaccggtgtttgtatcgccacttccggccctggcgccactaacctgatcactggcctggcggatgcgttgttagattcggtccccgtcgtcgcgatcacgggtcaggtttccgccccgttcatcggcaccgatgcgttccaggaggtggatgtgttagggctgtcgctggcctgtaccaaacacagcttcctggtgcagtcgctggaagagttgccgcgcatcatggcggaggcttttgaagtcgccaacgctggccgtcctggcccggttctggtggatatcccgaaagatatccagttggccagcggtgagctggaaccctggtttactaccgttgctaacgaagcgactttcccgcaggctgatgtggaacaggcgcgccagatgctggaacaggcgaaaaaacccatgctgtacgtcggcggtggtgttggtatggcgcaggcagttccggcgctgcgtaaatttatcgcggtaacgcaaatgccagttacctgcacgctgaaagggctgggggctgttgaagctgattatccgtactatctgggcatgctgggaatgcacggtactaaagcggctaatttcgcggtgcaagagtgtgatttactgatcgcagtgggtgcacgttttgatgaccgggtgaccggtaagctgaatacgtttgcgccgaacgccagcgtaatccatatggatatcgacccggcggaaatgaacaaactgcgtcaggcacacgtcgcgttgcagggcgatttaaattcgctgttgccggcattacagcaaccgctgaagatcgacgcatggcgtcagtcctgtgcagagctgcgcgcagaacacgcctggcgctatgaccatcctggcgagactatctatgcgccgttgttgttgaagcaattgtcggaacgcaaacccgcagacagcgtggtgacgacggatgtggggcagcatcagatgtggtcagcccagcatatgacttacacccgcccggagaacttcatcacctccagcggtctggggacgatgggattcggcttaccggcggccgttggcgcgcaggtagcgcgaccgaatgataccgttatctgtatctccggtgacggctccttcatgatgaatgttcaggagttgggcaccgtaaaacgcaagcagttaccgttgaagatagtcttactcgacaaccagcggttagggatggttcgacaatggcagcaactgtttttccaggagcgatatagcgaaaccaccctgaccgataaccccgatttcctcatgctggccagcgccttcggcattccaggccagcacattactcgtaaagaccaggttgaagcggcactcgacacgatgttggcaagcgaagggccgtacctgcttcacgtctcaatcgacgaacttgaaaatgtctggccgttggtgccgcctggcgccagtaactctgaaatgctggagaaattatcatgatgcaacatcaggtcaatgtatcggcacgctttaatccagaaaccttagaacgtgttttacgcgtggtgcgccatcgtggttttcaggtgtgctccatgaatatggaagccgcgaccgatgcgcagaatataaatattgaattgaccgttgccagtccccggtcggtcgacttactgtttagtcagttaagtaaactggtagatgttgcgcatgtcgcgatctgccagagcgctgccacatcacaacaaatccgcgcctgagcgcaaaaggaagaaaaatgacgacgaaaaaagctgattatatttggttcaatggcgagatggtgcgctgggaagacgcgaaggttcacgtaatgtctcacgcgctgcactacggtacgtcggtatttgaagggattcggtgctacgactctcacaaaggtccggtagtgtttcgtcatcgtgaacatatgcagcgcctgcgcgactcagcaaaaatttatcgttttccggtttcccagagcattgatgagctgatggaagcctgccgcgacgtaattcgtaaaaataatctgaccagcgcctatatccgtccgttggtatttgtcggcgatgtcggtatgggcgttaacccgcccccgggatacaccactgacgtcatcatcgccgcgttcccgtggggggcatacctgggcgccgaagcgctggatcaggggatcgatgcgatggtttcttcctggaaccgcgctgcgccgaacaccattccgaccgccgccaaagcgggcgggaactatctttcctcactgctggtgggtagcgaagcgcgccgccacggctatcaggaaggcatcgccctggatgtaaacggctatatctccgaaggcgcaggtgaaaacctgtttgaggtaaaagatggcgtgctgtttactccgccgtttacctcttccgcgctgccaggcattactcgcgacgcgattatcaaactggcgaaagagctgggtattgaagtgcgcgagcaggtgctgtcccgtgaatcgctgtatctggccgacgaagtgtttatgtccggaaccgcggcagaaattactccggtacgcagcgttgatggtatccaggtaggtgaaggccgttgcggccctgttaccaagcgtattcaacaagccttctttggtctcttcactggagaaaccgaggataaatggggctggttggatccggtaaattcataataaataaaattaatattttcccaaaataatttgcgtcacaggaaggcggtaacgcagcgaatccccagaagcttactgtagtaagtgactggggtgagtgaggcagccaacgcacctgtggcgtgaagtatgaagggaaaagatggggagtaaataaagcatgcctaagtaccgttccgccaccaccactcatggtcgtaatatggcgggtgcccgcgcgctgtggcgcgccaccggaatgaccgacagtgattttggcaaaccgattatcgccgtggtgaactcattcactcagtttgtgccgggtcacgttcatctgcgcgatctcggtaagctggtcgccgaacagattgaagcttccggcggggtggcgaaagagttcaacactattgccgtggatgacgggattgccatggggcacgggggtatgctctattcactgccgtcgcgcgagctgatcgccgactccgttgagtacatggtgaacgctcactgcgctgacgcgatggtgtgtatctccaactgcgacaaaatcaccccagggatgctcatggcctcgctgcgcctgaatattccggtgatctttgtctccggcggcccgatggaagccgggaaaaccaagctttcagacaaaattatcaagctggatctggttgatgccatgattcagggagcggacccgaaagtctctgacgatcaaagtaaccaggttgaacgctccgcctgtccaacctgcggctcctgctccggcatgtttaccgctaactccatgaactgcctgaccgaagcgctgggcctgtcgcagccgggcaacggctcgctgctggcaactcacgctgaccgtaagcagttgttcctcaatgccggtaagcggattgttgaactgactaaacgctattacgagcaaaacgacgaaagtgcactgccgcgtaacatcgccagcaaagccgcgtttgaaaacgcgatgacgctggatatcgcgatgggcggttcgaccaacaccgttcttcacctgctggcggcggcgcaggaagcggaaatcgacttcaccatgagtgatatcgacaagctgtcccgcaaggtgccgcagctgtgtaaagtggcgccaagtacccagaaataccatatggaagatgttcaccgtgccggcggtgtgctgggtattttaggcgagctggatcgcgccgggctgctgaaccgcaacgtgaaaaacgtattaggcctgacgttgccgcaaacgctggaacagtacgacatcacggttacgcaggacgaagcggttaaaaaaatgttccgtgctggccctgccggtatccgtactacccaggcgttctcgcaggattgtcgctgggattcgctggatgacgaccgcgcagcgggttgcatccgctcgctggaatatgcctatagcaaagacggcggtctggcggtgctgtatggcaacttcgccgaaaacggctgcattgtgaaaaccgcaggcgtggatgacagcatccttaaatttaccggcccggctaaagtgtatgaaagccaggacgacgcggtagaggcgattctcggcggcaaagtagtggaaggcgatgtagtcgtgatccgctacgaagggccgaaaggcgggccgggaatgcaggaaatgctctatccgaccagtttcctgaagtcgatggggctgggcaaagcctgcgcgctcatcaccgatgggcgtttctccggcggtacttcgggtctttccatcggccacgtctcgccggaagcggccagcggcggcactattgcgttgattgaagatggcgacactattgcgattgatatcccgaaccgcagcattcagttgcagttgagtgaggctgaaatcgccgcacgccgcgaggcgcaggaagctcgtggcgacaaagcctggacgccgaaaaatcgtcagcgtcaggtttcgtttgccctgcgtgcctacgccagcctggcgaccagcgccgataaaggcgcggtgcgcgataaatcgaaattgggaggttgatgatggcggaatctcaacctctgtcagtcgcgccggaaggggcggagtatctgcgcgcggtgctacgcgcgccagtatacgaagcggcgcaggtgacaccgctgcaaaaaatggaaaagctctcgtcacgtctggacaacgttattctcgtcaaacgcgaagaccggcagccggtacatagctttaagctgcgcggcgcttacgcgatgatggccggattgaccgaagaacaaaaagcccacggcgtgattaccgcgtcggcggggaaccatgcacagggcgtggcgttttcctccgcgcggcttggcgtgaagtcgctgatcgtcatgccaaaagcaacggcggatattaaagtcgatgcggtacgcggttttggcggcgaagtgctgttgcacggcgctaattttgatgaagcgaaagcgaaagctattgaactggcgcagcagcagggttttacttgggtgccgccgtttgatcacccaatggtgatcgccgggcagggcacgctggcgctggaactgcttcagcaggattcgcatctcgatcgtgtctttgtgccggttggcggcggcggcctggcggcgggcgtagcggtactgatcaaacaattgatgccgcaaatcaaagtgattgccgtcgaagcggaggattccgcctgcctgaaagcggcgttggaagccggtcatccagtggatctcccgcgcgttgggttgtttgctgaaggcgtagcggtaaaacgcatcggcgacgaaaccttccgcctgtgccaggaatatctcgacgacattattacagtcgatagcgacgctatctgcgcggcgatgaaagatctgtttgaagatgtgcgtgcggtggcggagccgtccggcgcgctggcgctggcggggatgaagaaatatatcgcccagcacaatattcgcggcgaacgcctggcgcacgtcctttccggcgccaacgtcaacttccacggcttgcgctatgtgtctgaacgctgcgagctgggggaacagcgcgaagcgttactggcggtgaccattccggaagaaaaggggagctttctcaaattctgccagttgcttggcgggcgtatggtcaccgaatttaactaccgttttgccgacgcgaaaaatgcctgtatttttgtcggcgtacgcgtcagtcaggggctggaggagcgaaaagagattatcacccaactgtgcgacggcggttatagcgtagtggatctctccgacgatgaaatggcgaagctgcatgtgcgctatatggtcggcggacgcccctccaagccattacaggagcgtttgtatagtttcgaatttccggagtcgcccggcgcgttgctcaaattcctgcatacgcttggcacgcactggaatatttcgctattccattaccgtagccacggtaccgattatggccgcgtgctggcggcgttcgagttaggcgatcatgagccggatttcgaaacccggctgcatgagctgggctatgaatgccatgatgagagcaataacccggcgttccggttctttctggcgggttaattcagcgtttagtttttcgggcccacaaagtaaagtgggcctgatatccagatattatcttccctcagttattgggcttttctgccagcccggagcatccactcatttcattttgcgagacgttttccagaaggcgcccaatctgcttgtggtgaaactcggctcaccatatcgttagcaccgccatcacttgcacctgctaaaaacaatgtataaaattttatacacaaaggatgttatgttactcactcgagctctctccaatgaaaaagaaattcgatgagtgggatcttctctggaggatctcctggcttttcccataacggtacgtaaagcagtcggttatcagcttcacaaaattcagtatggaattgaacccgatgactggaaaccgttttcagaaattggggctggggtaaatgaaattcgtattcgtgacaacaatggtatctatcgcgttatgtatgtcgctaagtttgaagaagcactctacgttttgcatagtttccaaaaacagacgcaacaaaccagtcagcatgataaaaacatcgccagaacgcgttataaccgggtggtgcaacaacggagaaacagcttgtgattgccaaaactgatagtgatattcgccatgtgacgccatctggcggtaatgtttttgctgatttggggtttcataagcaggacgcagaaaagttttacgctgattccctgaatgaaatcgaaaacacgttagccattaaacaacagctaatggaagaaattaccctctggattacgcaaaaccagatgaagcaagccgaggttgctacagttttgcatatatcccgaccgcgcgtttcggatgtcgtcaacaagaaatgcagcaaattcaccattgatgctctggtgaatatgcttagccgtattgggaagcctgttcgggtaatggtagggccgtaaaactaattcggtaaaatcttccagaacgcatcaattagcggctcatgcagccgctttttttgcgcgcagacgccgagttcaaacggcgttttttcatcgctgcgttctaaaatcatcacccggttgcgcactggctccgggctgttttccagcaccacttccggcagcagcgccacgccgcagcccagcgccaccattgagaccatcgcttcgtgaccgccgacggtggcgtaaatctgcggattgctgattttatgccggcggaaccatagctcaatgcgacggcgtaccggcccctggtcggccatgataaacggcaccgtcgaccagtctggcttgtcgaccgaaacctgattacgcaccgggcagggcagcgccggggcgatcagcaccaccgccagattttccagcatcgaaaacgccactgcgccgggcagcgtttctggtttgccggcgattgccagatcggcctcgccggtgactactttttccatcgcatcggcggcgtcgccggtggtgagcttaatttccaccgagggatgctcggcgcgaaaacggtcgaggattggcggcaggtggctgtatgccgcggtcactgaacagaagatatggagttcgccggaaagggacggcccctgctgatcgagggtatggcgcagctgctggtactgcaaaagcgtctgttgggcaaacactcgcagctcttcacccgcttcggtcagcgtgaccgtacggttatcgcgcacaaacagcggctggccgagatcttcttccagccgctgaatctgccgggagagcgtggaggggctgacgtgcatcgcccgcgcgctgcggccaaagtggcggctttccgccagatgcaagaaggtttttagatcgcgtaaatccacagacagacctccggtttttgacgttgcataaaccgcaacataacgttgtgaatatatcaatttccgcaataaatttcctgttgtaatgtgggttcattcgcacagatagcaatctgtaaaccgaacaataagcgcgacacacaacatcacggagtacaccatcatggctaactactttaatacactgaatctgcgccagcagctggcgcagttgggtaaatgccgctttatgggccgcgacgaattcgccgacggcgcgagctaccttcagggtaaaaaagtggtcatcgtcggctgtggcgctcagggtctgaaccagggcctgaacatgcgtgactccggtctggatatttcctacgccctgcgtaaagaagccattgctgagaagcgtgcttcctggcgtaaagcgaccgagaacggcttcaaagtaggcacctacgaagagctgatcccgcaggctgacctggtagttaacctgacgccggacaaacagcactccgacgtggtgcgttccgtacagccgctgatgaaagacggcgcggcgctgggctactcccacggcttcaacatcgtggaagtgggcgagcagatccgtaaagacatcaccgtggtgatggtggcgccgaagtgtccgggcaccgaagtacgtgaagaatacaagcgtggcttcggtgtgccgacgctgatcgccgttcacccggaaaacgatccgcaaggcgaaggcatggcgattgctaaagcctgggcggcggcgaccggcggtcaccgtgcgggcgtactggagtcttctttcgtggcggaagtgaaatccgacctgatgggcgagcagaccatcctgtgcggtatgctgcaggccggttctctgctgtgtttcgacaagctggtggcagaaggcaccgacccggcttatgcggaaaaactgattcagttcggctgggaaaccatcaccgaagcgctgaagcagggcggcatcaccctgatgatggaccgtctgtctaacccggcgaaactgcgtgcttacgcgctgtccgaacagctgaaagagatcatggcgccgctgttccagaaacacatggatgacatcatctccggcgaattctcttccggcatgatggctgactgggctaacgacgataagaaactgctgacctggcgtgaagagaccggcaaaaccgcgttcgaaaccgcgccgcagtatgaaggcaaaatcggcgagcaggagtactttgataaaggcgtgctgatgatcgcgatggtgaaagcgggcgttgagttggcgttcgaaactatggtggattccggcatcatcgaagaatccgcttactacgaatcactgcacgagctgccgctgatcgccaacaccatcgcccgtaagcgtctgtacgaaatgaacgtggttatctctgataccgcagaatacggtaactacctgttctcttacgcttgcgtaccgctgctgaaaccgtttatggcggaattgcaaccgggcgatctgggtagtgctatcccggaaggcgcggtagacaacgcacagcttcgcgacgtgaacgacgcgattcgtagtcatgcgattgagcaggtaggtaagaaactgcgcggctatatgacggatatgaagcgtattgcggtagcgggttgatataccttgtcggggggcgctagcgcttacctgacctacaaaatcaagcagacgatgtaggccgggtaaggcgtagccgccacccggctttttatttacgatacaataccttaatgatgtggtaaccgaactgggtatgcagcgggccggttggctccagtaccgggcaggaaaagactactttatcgaatgccggaaccatctggccctgacgaaattcgcctaaatgaccgccttttttaccggatgggcagatagaatgcttcttcgccagcttctcaaaatcgccgccgtttttaatttgctccagaagatctaaagccagtttctcttcttttacaagaatatgcagtgctgctgccatttttgccattattgtgttctcacgtcgcaaagattggccgtcactttatcactccttaggccgtcagacatatactcttcgccattacaggacagatgtcccgcctgatttaatgaaccgggagataagcagcatttttagcgggcgtatttcggatgtgcgggacggcggtcctgtcctttctgacaaggggcgagataccatgaacataatgaaaaacgcagaatttccagacgactggcttttagggctacgccaggtcgtacgcgacccagtgctctatgaattactcaaatactgcccgttggaaatcatgcagtacagggcgtttatgcgatgtcgcttgagtatgttctgctgacggcgatcgcgctaatgggttctttcagttggatcaagagcgcacagcgtaatggctatatgccgcttgccgccagagcctgctgattgaccttttccaggctgcctgaaaaagcagcctggtcttctctgggcctcgctttctgctacaatccctcccccgttcgaagattgagcactattcccatgcgtttaaatcccggccaacaacacgctgtcgaattcgtcaccggaccctgcctggtgctggcaggagcgggttctggtaaaactcgcgtaattaccaataaaatcgcccacctgatccgcggatgcggctatcaggcccggcatattgcggcggtgacgtttaccaacaaggcagcgcgtgagatgaaagaacgggttgggcagacgctcggccgtaaggaagcgcgcggtttgatgatctccacctttcatacgctagggctggatattattaagcgcgagtacgctgcgctggggatgaaatcgaacttttcattgtttgacgataccgaccaggtcgccttgctcaaagagctgaccgaaggcctgatcgaagacgacaaggttctgttgcaacagctgatctccacgatctccaactggaaaaacgatctcaaaacgcctgcgcaggcggcggccggggcgaaaggcgaacgcgatcgtatttttgcccactgctacgggctttacgacgcccatatgaaggcatgtaacgttctcgattttgatgatttgattttgctgccgacgctgctgctgcaacgcaatgacgaggtgcgcgagcgctggcagaataaaattcgttatctgctggtggatgaatatcaggatactaacaccagccagtatgagttggttaagctgctggtcgggcaacgcgcgcgctttacggtcgtaggcgatgacgatcagtctatctactcctggcgcggggcgcgtccgcaaaacctggtgttactgagccaggattttccggcgctgcaggtgattaagctggagcaaaactatcgttcttcgggccgcatcctgaaagcggcgaatattctcatcgccaacaatccgcacgtctttgaaaagcgcctcttttccgagctcggttacggcgcggaactcaaagtgttaagcgcaaacaatgaagagcatgaagctgagcgcgttaccggcgaactgattgcccatcactttgtgaacaagacccagtacaaggattacgccattctgtatcgcgggaatcatcagtcgcgggtatttgaaaaattcctcatgcagaaccgcattccgtacaaaatttccggcggcacctcatttttctcccgtccggagattaaagacctgctggcctacctgcgggtgttgaccaacccggatgatgacagcgctttcctgcgcatcgtgaatacgccaaaacgcgaaatcggtccggccacgctgcaaaagctgggtgaatgggcaatgacgcgtaataaaagcctgtttaccgccagctttgatatgggacttagccaaaagctgaccggacgtggttacgattcattgacgcgttttacccactggctgggggaaatccagcgtctggccgaacgcgagcctgtcgccgccgtgcgcgatctcatccacggtattgactatgaatcctggttgtacgaaacctcgccgagccccaaagcggcggaaatgcgtatgaaaaacgttaaccagctctttagctggatgactgagatgctggaaggcaacgaactcgatgagccgatgacgctgacccaggtggttacacgctttacactgcgcgatatgatggagcgtggcgagagcgaagaagagctggatcaggtacagttgatgacgcttcatgcatcgaaaggactggaattcccgtatgtctatatggtgggaatggaagaaggatttttgccgcatcaaagcagcattgacgaagataatattgaggaagagcgtcggctggcctatgttgggatcactcgcgcgcagaaagagctcacctttacattatgtaaagagcgccgtcagtatggggaactggtgcgcccggaacccagccgcttcctgttagaactcccgcaggatgatttaatctgggagcaggagcgcaaagtggtaagcgctgaggagcgaatgcaaaaagggcaaagtcacctggctaatctgaaagccatgatggcggcaaagcgagcgaaatcgtaggccggataagcgaagcgtcatccggcaatcaaactacggttagcgaacgtccagcggccagtgtacatagctttgccactggctttcctgatcaatcaactctttacccagcgggtgatgcgccagccagtcgccaggcaaggttaacgtcagattttcatttagcgcctgtagcgtaatttctggtaccagatcgtcacgacggcgaccagcaaaaagaatcgccaggcgcagcaaacggcatagctgttccgcaacacggggcggtaccgcgttttgctgatgaagcgaagagagatcgaccggattggtctgattcagtaagagggtggcgagcaattttttctgcgcgggcgtatagccaggcagatccaaatggcgtactaaataggcggcatgatagggcgcctgtttaaaatcaacgctcagaccgatctcatgcaactggcaagcgctaagcaacagttcacgactgataggctcaatatgccaggcattttctacctgtttgaggaagttatctgccagcttcgctacgcgatttgcctgatcggtatcgacgataaaccgacgctgaatgtttcgcagcgtgcggctgcggatatcctgatctaccgccagatgcaacatcccatacaccagcccttcgcgtaacgcgccgcctgccagcgtcatgctctggatgttcagctcggtaaatattgcgatcagaatagccagcccgcttgggaaaaccagcgcgcgctccagcgtcaggccttcgatttccagctcttccagacgcccgcactgtatcgcgcgttgttttagctgctgcagtttggcgagcgtaatgcgctcgtccatcccctgcgccatcatgatttcctgcaatgcctgtacggtgccggaggcacccacgcagaccttccagccatgaaaacgcagttcatcggcgaccggacgcagtacatcgcgcgcggctttctccgcgtcatcaaaattttcttgcgccagattacgatcgctaaaatagcgttcaagccacgttacgcagcccatcgacaggctaaacagcgacgtggtttgcgcgccagtgccggtaaccagttcagtgctggcgccgccgatatccaccaccagtcgctgatctgcgccgccggtggtatgagcgactccctgataaatcagccgcgcctcttcttcgccgctgataacctgcaccggacaaccaaggatagtctgcgctttcgcgataaattcccccgcattaacggcgagacgcaatgttgcggtggcaaccacgcggatttgcggctgcgggatatcctgcaaacgttcagcaaacagacgcaggcattgccagccgcgttccatcgcttcggccgaaaggtggttgtcgttgttcagacccgcggccagacgcaccttgcgttttattcgggtcagcgtctggatgcttcccgccgcctcgcgcacgaccagcatatgaaaactattggaaccgagatcaatggcggcatacaacgaggtggaattcatacacttcatccttcaacctgtatccgtgttggctgcgtactcttcctaagctcatcgggatttgttttcttgccgccttgatacaggctaaatgattttgtgtatggcataacttttcttaacctgaacgacgacgattacgcggagcgccagcgcggcgcggaccattgccaggacgcgaacgcgtcagacgcaacggcttgggcagatcgttcatgagcgcttccggattgtatttgctgaccggaatcgagtggccgatatagctctcaatggcgggcagattcagcgcatactcttcgcaagccaggctgatggaatgtccgctggcgccagcgcgaccggtacgaccgatacggtgaacatagtcttcacaatcgtctggcagatcgtagttaaagacgtgcgttacggcggggatatgcaacccgcgcgccgcgacatcggtcgccacaagaatatccagatcgccgcgggtgaactcatccagaatccgcaggcgctttttctgcgcgacgtcgccggtcagcagaccaacacgatggccatctgccgccagatgtccccagatatcttcgcaacgatgcttggtgttggcgaaaataatggcgcgatccggccactcttcttcgatcagcgtttgcagtaaacgcattttctcttcattagaggggtagaaaagctcttctttaatgcggtggccggtcttttgctccggttccacttcaacatattcggcgttgttcatctgttcaaacgccagctcgcgaacccgataagacagggtggcggagaacaacatgttcagacgctgcgcagccggcggcatacgacggaacagccagcggatatctttaataaagcccaaatcgtacatgcgatcggcttcatcgagtacgacgacctgaatggcgccgaggttaatgtgattttgtttggcgtagtcgatcagtcggcccgtcgtaccaataagaatatcaacgccgctttccagcactttaagctgcttgtcgtaaccatcgccgccgtaagccaggcctaattttaagcctgtcgcttgcgccaacggctccgcgtctgcgtgaatttgtacggctaattcacgcgtcggcgccatgatcagcgcgcgcggctggttcaccttgcgatcgtcgatcgcgggatgagaaagtaaataatgaaacgttgacgtcagaaacgccatcgttttcccggtaccggtttgcgcctgccctgcaacgtcacgacccgccagcgttagcggaagggccagtgcctgaatgggcgtacaattataaaacccttttttttcaagggcttcaaccacctgtgggtgcagggcgaagtcggaaaacttctgttctgttaaatgtgttttgctcatagtgtggtagaatatcagcttactattgctttacgaaagcgtatccggtgaaataaagtcaacctttgttggcgaagttaacatcagcacctcgttggttaatgctacaccaacacgccaggcttattcctgtggagttatatatgagcgataaaattattcacctgactgacgacagttttgacacggatgtactcaaagcggacggggctatcctcgttgatttctgggcagagtggtgcgggccgtgtaaaatgatcgctccgattctggatgaaatcgctgacgaatatcagggcaaattgaccgttgccaaactgaacattgaccagaacccaggtactgcgcctaaatatggcatccgcggtattccgactctgctgctgtttaaaaacggcgaagtggcggcaaccaaagtaggcgcactgtctaaaggtcagttgaaagagtttctcgacgccaatctggcgtaataccttttatacgtcgaatgacaaaggcgctgtatggtcaggcgtctgtcattcgacgaatgattaaggtatcaggcagtttcgtggcgtctgttgtccttacgttattcttaaattgtcaggatctctggacgcccggtctgagtcgtgctaagttagtattgacttcgaattaaacataccttattaagtttgaatctggttttatccgtcacttcccgttttttctcgcacgagaagtggaaagattcctggctcttcgctcattccgtcttgtcgtttcagttctgcgtactttcctgtgaccagacagcgaacagacatgagttgatagccgtaaacaggcatggatgaccctgccataccattcacaacattaagttcgagatttaccccaagtttaagaactcacaccattatgaatcttaccgaattaaagaatacgccggtttctgagctgatcactctcggcgaaagtatggggctggaaaacctggcccgtatgcgcaagcaggacattatttttgccatcctgaagcagcacgcaaagagtggcgaagatatctttggcgacggtgtgctggagatattgcaggatggatttggtttcctccgttctgcagacagctcctacctcgccggtcctgatgatatctacgtttcccccagccaaatccgccgtttcaacctccgcactggtgataccatttctggtaagattcgcccgccgaaagaaggtgaacgctattttgcgctgttgaaagttaacgaagttaactacgacaaaccggaaaacgcccgtaacaaaatcctctttgagaacttaaccccgctgcacgcaaactctcgtctgcgtatggagcgtggtaacggttctaccgaagacttaacggcgcgcgttctggatctggcttcgccgatcggtcgcggccagcgcggtctgattgtcgcgccgccgaaagcgggtaaaaccatgctgctgcagaacatcgcgcagagcatcgcgtataaccacccggactgcgtgctgatggtgctgctgattgacgaacgtccggaagaagtgaccgagatgcagcgtctggtgaaaggcgaagtggttgcttctacctttgacgaaccggcatcccgccacgttcaggttgccgaaatggttatcgagaaggcgaagcgtctggttgaacacaagaaagacgttatcatcctgctcgactccatcacccgtctggcgcgcgcctacaacaccgtggtgccggcttccggtaaagtattgaccggtggtgtggacgctaacgccctgcatcgtccgaagcgtttcttcggcgcggcgcgtaacgtggaagagggcggtagcctgactatcatcgcgacggcgctaatcgataccggttccaagatggacgaagttatctacgaagagtttaaaggcaccggtaacatggagctgcatctctcgcgtaagatcgctgaaaaacgtgtcttcccggctatcgactacaaccgttccggtacccgtaaagaagagctgctcaccactcaggaagagctgcagaaaatgtggatcctgcgtaaaatcatccatccgatgggtgaaattgacgcgatggaattcctcattaacaaactggcgatgaccaaaactaatgacgactttttcgagatgatgaagcgctcataacctggtctttacctgaaaacgccacgtttttacgtggcgtttttgttttgcgattcatcctggcgtcatgtcatataaactggtcatcgggatatgcgctacagagtaacaccatgcacaatacacattgtttgcggtaaaaagtgtaatgttctaacaggtctcttctaggagctggcgtaacgcattatactttaaggaaatgatatatgctgagagcacatacactgtgaagttactcaccgctttatctgagctaatcagtatttttttattcacgaccatttttatttttcttgcgcgaaaagtagccataaaaattggtttagtggataaaccaaactttcgtaaacgacatcagggcgttatcccattagtcggcgggatttctgtgtttgcaggaatctgctttatgtttggcctctcggattactacataccgcacttatcgctatatcttatttgcgctggtgtattggtttttgttggtgcgatggatgaccgttttgatatcagtgtaaaaattcgtgctgtggttcaggctgttattgcggttgtaatgatggttatcgcaaaacttcacttaggtagccttggttacatctttgggccttgggagttagtgcttggcccctttggctatttccttactctgtttgcggtatgggcggcgatcaacgctttcaatatggtggacggtattgacggcctgctgggtgggttatccagcgtctcatttgcggcgatggggctgattttatggtttgatggtcagactagtctggcaatgtggtgctttgccatgatcgccgcgattctgccttacattatgcttaatctcggtattttggggcggcgttacaaagtctttatgggcgatgccggtagtacactgattggctttaccgtcatctggctcttactggaaacgacgcaggggaaaactcactctatcagcccggttaccgcgctatggattatcgctattccattgatggatatggtggcgattatgtatcgccgtctgcgtaaagggatgagccccttttcccctgatcgccaacatattcatcatttggttatgcgagcagggtttacttcccgccaggcatttgttcttattacgctcgcagcggcgattctggcgggagtaggcgtaacggcagaatactctcattttgttcctgaatgggttatgttggtgctctttttgctagcattcttcctctatggctactgcattaagcgggcctggaaggtggcgagatttattaagcgtgtgaagcgtcgcctgcgcaggcaacgtgagaaccggccaaacttaaccaagtaaatgaggatacgatgacacaaccattaccgggggcacgcgcggtgagcgctgaaaatgaactggatattcgcgggttgtttcgtactttatgggctggcaaattctggattatcggcattggcctgctatttgcccttatcgcgttagcctataccttttttgctcgtcaggagtggagtgcgacggcgatcaccgatcgcccaaccgtaaatatgttgggcggttattactcccagcagcagtttctgcgcaacctggatattaagaccgatcctgcttcttctgataagccctcggtgatggatgaagcgtataaagagttcatcatgcaacttgcctcctgggatacgcgtcgcgatttctggttacagacggactattacaagcagcgaatggtcgggaatagcaaagctgatgcggcgatgcttgatgaactgatcaataacatacagtttacgcccggcgattttacacgcgccatcaacgacaatgtgaagctgattgctgaaactgcgccggacgccaataatctgctgcgtcagtatgtcgcattcgccagccagcgggcggcgagccatctgaatgatgaattaaaaggtgcctgggctgcgcgtaccgtgcagatgaaagcccaggtcaaacggcaggaggaggttgcgaaagcgatctattcgcgtcgtgtaaacagtattgagcaggcgctcaaaattgcggaacaacataatatttctcgtagcgcgacggatgtcccggcggatgaattaccggactcagagctttttttactcggtcgccctatgttgcaggcgcgtcttgaaaatctgcaagcggttggccctgcgttcgatttggactactttcaaaatcgggcaatgttgaatacgcttaatgtggggccgaccctggaccctcgttttcagacctatcgttatttgcgtacgccggaagaaccggtaaaacgtgatagcccacgccgagccttcctgatgatcatgtggggtatcgttggggcgctaatcggtgcgggcgttgccttaacccgtcgccgcacgatttagcaacacctctgcagtagggggctgggcccctactgtctattcgaagagaatcgatgtgaaagtactgactgtatttggtacacgaccggaggccattaagatggcgcctctggtccatgcgctggaaaaagatcctcatttcgaggccaaagtatgcgttactgcgcagcatcgggagatgcttgatcaggtattaactcttttttctattgtgcctgattacgatctcaacattatgcagccgggacaggggttgacggaaattacctgccgaattctggagggattaaagccgatcctggcagattttaaacctgatgtggtgctggttcatggcgataccaccactacgattgctaccagcctggcggctttctatcaacgaattccggtagggcacgtagaagccgggttgcgaaccggcgatctctattccccctggccggaagaggcaaaccgcacgctgaccggacatctggcgatgtaccactttgcgccgacggaaaactcgcggcagaatctgttgcgggagaacattccggatgagcgcatttttgtcactggcaataccgttatcgacgcgctgatctgggtacgcgatcgcgttctgacgagcgatacattacaggctgaactggccgagcagtatcctttcctcaacgcgaataagaagatgattttagtgaccggtcatcggcgtgaaagctttggtcagggctttgagcatatctgccaggcgctggcggaaatcgccgccgcgaaccagaatgtgcaaattgtctatccggtgcatctcaatcccaacgtcagcgaacctgtcaaccgtatcctcggccatgttgaaaacgtggtactgattgagccgcaggactacttaccttttgtctggctgatgaatcacgcctggctcattctgaccgattccggcggtattcaggaagaagcgccgtcattaggtaagccggtattggtcatgcgtgaaaccacagagcgtccggaagccattaccgctggtacggtaagactgatcggcacggactcccggcgcattgtggcggaagttatgcgtctgctgcacgacgaaaatgaatatcaaaccatgagccgcgcccataatccttatggtgacgggcaatcatgcgcgcgcattttacaggcgttaaaaagttatcgggtatcgttatgagttttacgaccatttctgttattgggctggggtatatcggattaccgactgcggccgcttttgcttcccgccagaagcaggttatcggcgtggatatcaaccaacatgcggtagacattataaatcgcggtgaaattcacatcgtggagccggcgttgggcaatgtggtgaagatggcggtggagggcggctttctgcgtgcgacgacgacacctgtcgaggccgatgcgtacctgattgccgtgccgacaccattcaaaggcgatcacgaccctgacatggcctatgtcgaagccgcggcgaaatccattgcgccagtattaaaaaaaggggcactggtgattctggaatcaacatcgccggtcggcgcaacggagcaaatggctggctggctggccgggatgcgcacggatctgacctttccccagcaggcgggcgagcaggccgatgtgaatatcgcctattgtccggagcgtgtgctgccgggtcaggtgatggtggaactcattaaaaatgaccgcgtgattggcggtatgacgccagtatgttcggctcgcgccagcgcgctgtacaaaattttccttgagggcgaatgcgttgtcaccaactcgcgcaccgcggagatgtgcaaactgacggaaaatagcttccgtgatgtgaatatcgcctttgcgaatgaattgtcgctgatttgcgccgaacaggggattaacgtttgggaattgatccgcctggcgaaccgccatccgcgcgtcaatattttgcagccgggcccaggcgttggcgggcactgcattgcggtcgatccgtggtttattgtggcgcaaaatccgcagcaggcgagactgattcgcaccgcgcgtgaagtgaacgacggcaaaccgcactgggtggtcgatcaggtaaaagccgcggtcacagattgcctggcggccaccgataaacgcgccagcgaagtgaaaatcgcctgttttgggctggcctttaagccgaatatcgacgatctgcgcgaaagcccggcgatggggatcgcgcaaagtatcgcccgctggcacagcggcgaaaccctggtcgtcgaaccgaatatccgtcagttgccgaaaaaattggacggactttgtacgctggcgaaactggacgcggcgctggccgccgccgatgtgctggtgatgctggtcgatcacgacgaatttaaagcgattcccggcgatgcggttcatcaacgttatgtggttgataccaaaggagtctggcgctgatgaaacgcattctggtgaccggcggcgcaggctttatcggatctgcggtggtgcggcatatcatccatgaaacggcagacgcggtggtggtggtggataaactcacctatgcgggcaacctgatgtctctggcgtcggtggcgcaaagcgaccgtttcgcctttgagaaggtggatatctgcgatcgggcatcactggagcgagttttccagcagtatcagcccgatagcgtgatgcacctggcggcggaaagccatgtagaccgttccatcgacggcccggcggcgtttattgaaacgaatatcgttggtacttacaccttgctggaagccgctcgcgcttactggtccgcgcttgacgcggacgctaaagcggcgttccgcttccaccatatctccaccgatgaagtgtatggcgatctgcatactgcagacgatttcttcaccgaaaccacgccatatgcgccaagcagcccttattccgcctccaaagccagcagcgaccatctggtacgcgcctggttacgtacctacggtctgcctacgcttgtcaccaactgctctaataactacgggccctaccatttcccggaaaaactgatcccgctgatgattctgaacgcgctggcgggtaaaccattgccggtctatggcaacggtcagcaaattcgcgactggctgtatgtggaggatcatgcccgtgcgttgtatcacgtggtgacgaacggcgcggtgggtgaaacgtataatatcggcggtcataacgaacgtaaaaatctggatgtggtcaggacgatctgcgctctactggaggaactggccccgcaaaaaccgcagggtgtggtgaattatcacgatctgattaccttcgtcgacgatcgccccggccatgacttacgttatgccatcgacgcgtcgaaaatcgcccgcgagctgggctggacgccgcaggaaaccttcgaaagcgggatgcgaaaaaccgttcagtggtatctcgccaatgaggcctggtggaaacccgtgcaggatggcagttatcagggcgaacgcttaggactgaaacgctaaacggcaggttcttactcctggaggagaaacgaatgaaaggcatcattctggcgggaggttccggtacccggttgcatcccattacgcgcggcgtatcaaagcgccagggcttcaaaattgcctgtctggaggagattgcctggcgcaacggctggctggatgatgatggtttgaaacgcgccgccagtcagcttgaaaaaaccggctatggccaatatttactggagttgctccgtgcccgtccgcgccagtattgaaccgttactctgggaaaatacgttctttggcgtgaatagcggcattgtgcgtatcgatgcctcagcgcccgaattaacgccagaagcactgcaggcgtggcaacgcgtgcaggtaaaagtgccggctgaaaacatcgcctggctgtcggcgttgcaatcgctgggattctctttggttgaaggcgaggtggattttgcgttgccggtaaaagggcatcgcgaccagcatggcgcggaaattgcacaccttacggacattcctgctttgcgtcagttggccggagaggcgtttacgcagagtcgttttcgcgcgccgtggtatgcgcccgacgccagcgcccgtttttacgcccagtggattgagaatgcggtacgcggcacgtttgatcaccaatgcctggtgcttcgcacggagacaggcgctatccgcggttacgtctcgctgcgggaattgaatgataccgacgcgcgcattggcctgttggccggacgcggcgcgggagcggaacttatgcaggcggcgatctgttgggcgcagagtcgcggcaaagcaacattgcgggtggcgacccagttgggcaacaccgccgcgcttaaacgttacatacaaagcggtgccaacatcgaaagcactgcgtactggttatacaggtgacaacatgattccttttaatgcgccgccggtggtgggaaccgaactcgaatacatgcagtctgcaatgagcagcggcaaactgtgcggcgacggcggctttacgcgtcgttgccagcagtggctggagcaacatttcggcagcgcgaaggtgttgctaacgccttcctgtaccgcatcgctggagatggcggctctgttgttggatattcagcccggcgatgaagtgatcatgccgagctttacgtttgtctccaccgctaacgcttttgtcctgcgcggcgcgaaaattgtgtttgtcgatattcgtccggatacgatgaatattgacgaaacgctgattgaggcggcgattactgataaaacccgcgctatcgtgccggtacactacgctggcgtcgcttgtgaaatggacgtcatcatggcgctggcggataagtataatctgttcgttgtcgaggatgccgcccagggtgtgatgtccacgtacaaagggcgcgcattagggacgatcggtcacatcggctgttttagcttccatgaaaccaaaaattacaccgctggcggcgaaggcggcgcgacgctgatcaacgatcgtacgctaattgaacgcgcggagatcatccgcgaaaaaggcaccaaccgtagccagttcttccgtggtcaggtggataaatacacctggcgggatatcggctccagttatttgatgtccgatctgcaggctgcctatctgtgggcgcaactggaggccgccgatcgtatcaatcaacagcgtctgtcgctgtggcagacttactacgatgcgttaacgccgctggcgcgcgccgggcgtttcgagctgccttctattccggaaaactgcgggcataatgcccatatgttttacatcaaactgcgggatatcgccgatcgcagcgcgctgattaatttcctgaaagaggcggaaatcatggcggtattccattacattccgctgcatgattgtccggcgggcgataaattcggcgagtttatcggggacgatgtctacaccacaaaagagagcgaacgtttgttgcgtctgccgctgttttataaccttgcgcccgtcgatcaacgaacggtgattactaccttgctaaattatttctcctgatatgtcgcttgctaaagcctccctgtggacggcggtcagtacgctggtaaaaattggcgccggactgctggtggtgaaactactggccgtctcttttggtccggcgggcgtcggacaagcgggtaacttccgccagatgattaccgtgctgggcgtattggctggcgccgggatatttaacggcgttaccaaacttgtcgcacaacatcatgataacccggcgcagttacgtaccgtggtgggaacctcctccgcgatggtattggggttctctacgctgctggcgctggtcttcttgctggcggcggcgccgattagccagggattgttcggtcatacggactatcaagggctggtgcgtctggttgcgctggtacaaatggggatcgcctgggcgaacctgctgctggcgctaatgaagggctttcgtgacgcgtcgggtaatgccttatcgttaattgtcggcagctttttgggcgtcgccgcctggtatctctgctaccgtgtcggcggctatgaaggcgctctgcttggcctggcgctggtgccggcgctggtggtagtgccagccggtataatactgattaagcgcggcaccgtcccgctacgctatctcaagccctcctgggacaacggtctggcagggcagctcagtaaatttaccctgatggcgctgattacctccgttacgatgccggttgcctatgtgatgatgcgaaaccaactggccgcgcactatagctggagcgatgtcgggatctggcagggcgtaagcagtatttctgacgcctatctgcaatttatcaccgcctccttcagcgtttacctgttacccacgctctcacgcctgacggaaaaacaggacattacgcgtgaagtggtaaaagcgctgaaatttgttttaccggcggttgcggcggcgagttttaccgtctggctactgcgcgattttgctatctggctgcttttttccgctaaattcaccgcgatgcgcgatctgttcgcctggcagttagtgggcgacgtgctgaaagtcggcgcctatgttttcggttatctggtgattgccaaagcgtcgttgcgattttacattctggctgaaattagccagttcattctgttaacggcgttcgctcactggctgattcccgctcacggcgcgctgggtgcggcacaggcttatatggccacctatattgtctatttttcactttgttgcggcgtatttttactctggcgtaggcgagcatgactgtactgattcacgtcctgggatcggatatccctcaccataaccacaccgtgctgcggtttttcaatgatacgctggccgccacaagcgagcacgcgcgcgaatttatggttgccggcgaagataacggcttcacggaaagctgcccggcgctctcgcttcgtttttatggcagtaagaaagcgctggcgcaggcggtcatcgccaaagcgaaagcaaatcgtcgacagagattcttctttcacggtcagttcaacaccagcctgtggctggcgctgttaagcggcggtattaagccagcccagttttactggcatatctggggcgcggatctctacgaagtgtcccacgggctgaaattccgccttttctacccgcttcgtcgtatcgcgcaggggcgagtagggggcgtattcgcgacgcgcggcgatctcagctattttgcgcgtcagcatccggacgtacgcggcgagttgctctatttcccgacgcgcatggacccttccctgaatgctatggcaaaagagcgccaacgtgcggggaaattgaccattttggtagggaactccggcgatcgcagtaaccaacacattgcggcgttacgggcggtgtatcagcagtttggcgacacggtaaacgtggtggtgccgatgggctatccggccaataaccaggactatattgatgaggttcgtcaggccggtctggcgctatttagcgccgaaaatttacaaattcttagcgaaaaaatggaatttgatgcctatcttgcgctgttgcgccagtgcgacctcggttattttatttttgcccgccaacaggggatcgggacgttgtgtctgctaattcaggccgatatcccgtgcgtactgaatcgcgacaatcctttctggcaggatatggcggaacagcatctgcccgtcctgtttaccacggacgatcttaatgagcaggtcgtgcgcgaggcgcagcgtcagctcgcatcggtagataaaagcggcatcaccttctttagccccaactacctgcaaccgtggcataatgcgttgagaatcgccgcaggagaagccgaatgagtttaatgcaattcagcgggctgctggtggtctggctgctctctacgctgtttatcgccacgctgacctggtttgaattccgccgcgtgcgttttaacttcaacgttttcttttcgttgctgtttttgttgaccttcttttttggttttccgctaaccagcgtgctggtatttcgtttcgacgttggcgtcgcgccgccggaaatcttattgcaggctctattatccgccgcctgtttctacggcgtgtattacgtgacctataaaacgcgtttacgcaaacgcgttgtggatgtaccacgcaagccgctatttaccatgaaccgggtggaaacccaccttacctgggtgatcctgatgggcatcgcgctggtgagcgtggcgattttctttatgcataacggctttttgctgttccggctgcactcctacagccagatcttttccagcgaagtctccggcgtggcgttaaaacggttcttctatttcttcattccggcgatgctggtggtctatttcctgcgccaggacagcaaagcgtggctgttctttctggtgagcaccgtcgcgtttggtctgttgacctacatgattgtcggcggcacgcgcgctaacatcattattgcgtttgctatcttcctgtttatcggcattattcggggctggatcagcctgtggatgctggcggcggcgggcgtgctggggattgtcggtatgttctggctggcgctcaaacgctacggattaaatgtgagcggcgatgaggcgttctatacgtttctttatctaacgcgcgataccttttcgccgtgggagaatctggcgctgctgttgcaaaattaccacaatatcgagtttcaggggctggcccctatcgtgcgtgatttctacgtctttattcccacctggttatggccgggacgacccagtattgtgctgaactctgcgaattacttcacttgggaagtcctgaacaaccattctggcctggcgatatcgccaacgcttatcggatcgctggtggtcatgggcggggcgctgtttattccgctcggcgcgatcgtcgtcgggctgattatcaaatggttcgactggctgtatgaactgggtaaccgggagcccaatcgctataaggcggcgattctgcacagtttctgctttggcgccatctttaatatgattgtgctggcgcgagaagggctggattcgtttgtttcgcgcgtggttttcttcctggtggtttttggcgccagcctgctggtcgctaagcttctgttctggttatttgatagcgccgggctgattcataaacgtacaacttcgctccctcaggcacaggtggaaggaaaactatgaccaataatgccgctgcgcccctttactcgctgcgtggattacctctgattggctggcgcgacatgtcacacgcgctgaattatctgtttgccgatggtcaactgaagcaaggcacgttggtggcgatcaacgccgaaaagctgctgacggcggaagataatccggaagtccgcgcgttgatagcggcggcggaatttaaatatgccgatggcatcagcgtggtgcgttcaatacgtaaaaaatttccgcaggcgcaggtttctcgtgtggctggcgccgacctttgggaagcgttaatggcgcgcgcgggaaaagaaggcacaccggtatttcttgtcggcggcaagcctgaggtgctggcgcagacggaagcaaaactgcggacgcagtggaacgtcaatattgtgggtagccaggacggttactttacgccggagcagcgtcaggcgctatttgcgcgtatccatgccagcggcgcgaaaattgtcaccgtcgcgatgggatcgccaaaacaggaattgctaatgcgcgattgtcgggaagtgcatccccatgcgttatatatgggggtgggcgggacctatgatgtgtttactggtcacgtcaaacgcgctccaaaaatatggcagaacctgggactggagtggttgtatcgtctgctttctcaaccgaggcgtattacccgccagatgcgcctgctgcgctatcttcgctggcactatactggcgatctctaattctcccttctgatgacttgagcagcggattgtgcttatggtgctgctcatttacaacataatcgatgatttcttacacaataagtgcatttttttaatgctccatttgccatttgtccaaatttaagaaaatattcgcaacaatcgatgtacccataacaataaccggtactaccggaaccgttgcaaacacgacatgaggatttatggcagagaaaaaaccggagctacagcgtgggctggaagctcgtcatattgaattgattgccctcgggggcaccatcggcgtcggactctttatgggcgccgccagtacgctgaaatgggcgggcccgtcagtgctgctggcgtatatcatcgccggattgttcgtctttttcatcatgcgttcgatgggggagatgctctttctggaacctgttaccggctcctttgccgtgtacgcccaccggtatatgagtcctttttttggctatcttaccgcctggtcatactggtttatgtggatggcggtcgggatctcggaaattaccgccattggggtctacgtccagttctggtttccggagatggcgcagtggataccggcgctgattgccgtcggactggtcgcgttggcgaatctggctgcggtgcgcctgtatggtgaaatcgagttctggtttgcgatgatcaaagtcaccacgattattgtgatgatcatcatcggtctgggggtgattttcttcggctttggtaacggcggccaggcgattggctttggtaatctgaccgagcatggcggcttttttgccggcggctggaaaggctttctgaccgcattgtgtatcgtggtggcctcttatcagggggttgagttgatcggtattaccgccggtgaagcgaagaatccgcaggtgacgttgcgtagcgcggtgggtaaagtgctgtggcgtatcctgattttttatgttggcgcgattttcgtgatcgtcaccattttcccgtggaatgagattggcagcaacggcagcccctttgtgctcaccttcgcgaaaatcggcatcaccgccgcggcaggcattatcaactttgtcgtgctgacggcggcgctctccggctgtaacagcggaatgtatagctgtgggcgtatgctttacgcgctggcgaaaaaccgtcaactgccggcggcagtcgcgaaagtctctcgccacggcgtgccggtcgcgggcgtggcgctctctattttgattttgctggtaggttcttgcctgaactacatcatccccaatccgcagcgcgtctttgtttacgtttatagcgccagcgtactgccggggatggtgccgtggtttgtcattctgattagccaactgcgctttcgtcgggcgcataaagaagcgattgcggatcatccttttcgttccattatgtttccgtgggcgaactatttgacgatggcgtttctggtttgcgttttaatcggcatgtactttaatgaagatacgcgcatgtcgctgtttgtcggcgtcatcttcctgctggccgtcacgctggtctacaaagttttcggtctgaatcgtcacggaaccgcccacaaggtgggggaataagcgccaaaatgcgcaaagcataaccaaacgcgcattttatttaaaaaggcactggacagcggggtgtgaagtccgtattatccacccccgcaacggcgctaagcgcccgtagctcagctggatagagcgctgccctccggaggcagaggtctcaggttcgaatcctgtcgggcgtaccatttatttaggtgcttgagctgcggtggtttaataccgcgtaaaaagtttcagtggtggctatagctcagttggtagagccctggattgtgattccagttgtcgtgggttcgaatcccattagccaccccattaatatagagttgtgaaacgcgaaggtggcggaattggtagacgcgctagcttcaggtgttagtgtccttacggacgtgggggttcaagtcccccccctcgcaccacgactcaatgaattgaactaaaaattcaaaaaagcagtatatcggcgagtagcgcagcttggtagcgcaactggtttgggaccagtgggtcggaggttcgaatcctctctcgccgaccaattttgaaccccgcttcggcggggttttttgttttctgttccttttcaaccccttatcccgcacgtgttgccattatgatttgttggcgatatcccaggcttcatttgtcgctattcggtgacgagtaatctattgatttataatcactttgtaaaaagcatcctgttctgtctccaccgggcgacacgctaaaacctcgccagcggcggggggatgacaatcgcgtgaattctctacgtttttttaatgcctgcgcctgttttttagcggtgcaaagatggcacgttatgtgcaataatgtacgggtagatgctcattccatctcttatgttcgccttctggcctcataaactcaggaatgatgcagagccgtttacggtgcttatcgtccactgacagatgtcgcttacgcctcatcaaacaccctggacacaacgttgagtgaagcacccctttatgttgtcatacagacctgttttgacgcctgccccttaaccgggcaggcgtttttttatgcatctcgaatgattttgtgtaggcggtaggcccggtaagcgaagcgccaccgggcaagagggaattactgcgggggattgttctgtaatgtcagcatcaggccgtcgcgccgcatggcggcggcctcttccggttgatgcagtcgatcaagcgcatcggcaagccaggcataatcatacgcgtccgggcgttgtttcagcgcggcgcggaaagccagggtcgcctcctgccattcaccgtgtttcattagcgactggccgagcgtgctccataacagcgggcgatcgcctaccgtcttgatttgctggcgcagcactttctccagttgttccggattattggttctgaggcgaggaatgggcagcaccagccgatcgtcatactggcgtttcagaccgtcgatgataatctgctgcgccatatcatgatcgtcacattcgatcagatgctcggccattgcgacctgcagcgccacctgatggcgggttttacggctttggtttttccaccaggtgcgtaatccttcgctgccctgctcggcgcgcgcctgatccatgagtcctatccacgcctgttgttcgagcatagcgcgatgcgcttcatcgccaacgtgcgctttcgccatggatgggatgatatccagtaaagaactccatgcgctggtgcgaatataggcctgctccgccagacgcagaacttccgggtgacgcggcgtgacctccagcagtttgtccacgccgtgacgcgccgcgtgattttcattgcgcgccagctgtaagcgcacgcgcgtgatctcgaccgggatggtgtcgttccccgccagctctgccgcacgttcaaggtgctgattagcgcgcgcttcatcgccgcgctgctgcgctgcttctgccgccagcagataatttaccaccggttgttcagcatgatcggcattttttgacatcagcttttcaacctgctgataatcgccctccgccagcttcagcagcgcctgttcggtctgcttgcgggcgcgacggcgtttacggccggcaaaccaaccgcgggtgtgcgcgccggtacgaaacagacggcgtagtaaccactcaatggcgaatagcaccaccatagcgacgatgagaatgatcgccaggccggtgacgctggtttcaatgttgtagttatcggtctggattaacacatagccctggtgaccggctatcatcgggccgaccacgatacccgcaagcaacaacacaaagagcaataatacttttagcatcattattctccttgcggcgcggctgccggagcgtctgtctgcgtggcaggcgctgccgtagagactgtcggttgcgccagcagattacgcacgcgggtttgcatcagtttttcaagaatcgcctggcttcccagggtttctggcagatccatcgtgatattttgctggcttaatttatcgacctcctccaggaaggcttttgtcgcggcgtcgtcagtatcgtaataagcgcgaacccaggtcgaaacgttatccagcgcctgacggtatgtttcttcctgatggcgtggcacggcctgcgcggcgactaacaggcgggagcgaatattttcgcgtaaatagacgtcctggttgggtgccaacagcggtacggcggtatcatcgcggcggcgaatggtaataaagctgtccataaagttctgccagcttttttgcaggttaacgcgccattcgcttaacgagctggacagctcgctgctgtctgaatccatcggcgaaccatcggtatcgttatccgccagacgcaggttatcgatttggttagagagctgattgagcttgagaataatgccgtcgtagtcgatctgcgcaacggatgacaggctggcgatatcgtcagtaatcgcgcgtcgtgcggtaatcaggctggggtcattcatgtccgccagactggcgtcagcgcttttgagcagcgcagcggcggtagtgacgtcctgatcgctccacagcttgcgtccggcgagtttcaccaggaaatcagcctgcgccagcagccaggttttagcatcgctgccggaaatagtggcgactttttgttgtacttcatcaagctgtttcgccagcgccgcctgttggcgattcgcgtcatctaactgcgccgcttgttttttgataatcccttccagctccgctttttggctctcctgcgccttttgcaaggcggtcagttgcgtcgccagcgcatcgctggtttccgtttgcgcggttgcttgctgtttcccccagccataaagcccaatacctgccgccagggcaatcgcaatcgccaccgcgcttaataccagcgcggcgccgttcttactttttttctcggtattaactggctgtggcgtggtttccacgctctccctggtctcatcaaccacggcggaggatttttcttgttccgtcattatggcatcccattatgagagttattgtaatgcgcgcaacagcgcatcgttgtcggcgttatcagcgaccttaatatcttgccagcccagttcccgggcgaggtgcgccagacgctcactgacgaccaatagccgacagcgtagtaaccagtgctcacgataccactggggagtcagcgaccagagccgttgcaacatctcgccgctggtaacaacaagcgttgttacgccgcgagtatgccagcgcatcgcttcttccgcgccatcgtaatgtttcgcacatcgttgataacattcacaaaaactgacttcggctccgcgcgctgtcagggtttcgcccagcagttcgcggccgccattgccacgcaaaatcagcgcgcgtttgcccgcaatattttgtaattcaggtaattgtagcaaggcttcgctgatttcccgatccaatggataacgaatatcgaacccgctaacggtatgaagggcgagcgccgtggtgcggccaatcgcgaaatagcgcggcgccacaggccagtttcgaccatcccgctggagctgggcgtgagcaaaggcgacagcgtgctgtgaaagggcaaaaaccagatcgttttccgtcagcgtcgccaggcggtcggccagggtgggtagctcccgaccggcgacaaattcaatcagtggaaaactccaggccacctgccccagtgcgcgcagacggctcactaacgcttcccctgcgggagaggggcgggtgatcagaatactcatgcgggcgtctcgccgttataaacttccgtcagaatcgcgcgtgcgccgttttccagcagttcctctgcaagcgagatgcccatttgctccgcctgctcgggagaaccacgacgttcgccgcgcaccatcaccgaaccgtccggcgcgccaaccagcgcgcgtagccaaatttcaccgttgatgatttctgcatagctgccaatcggcacctgacaaccgccttccaggcgggtgttcatagcgcgttccgccgttacgcgcagcgcggtttgcgagtgattcaacggtgcgagcagcgcctgtgttcgcgcgtcgtcaagacgacactcaatcccgacggcgccctggcctacggcaggaagcgaaacgtcgggcggcaaggctgtgcgaatgcgcgactccagacctaagcgtttcagaccggccacggccaggataatggcgtcatagtcgccgttgtccagcttgccgagacgtgtgccgacgttgccgcgcaacgaacggataatgaggtccggacggcgttccgccagttgacactgacgacgcaaactggacgtcccgacgatactacccgcgggcagatcgtccagactgtgatatttattcgagacaaacgcgtcgcgcggatcttcgcgctcgcaaatggtcaccagaccgagaccgtccgggaaggccaccggaacgtctttcatagagtgcacggcgatatcagcacgtttttccagcagcgcgatttcaagctctttaacaaacagtcccttaccgcccactttcgccaggggagtatcgagaatcacgtcgccgcgtgtgaccatcggcaccagttctaccgtcagtcccggatgggttgccatcaatgcgtctttgacataatgtgcctgccaaagcgcaaggggactttggcgtgtggcaattcttaaaacattgtctaacatgcttgttaccgtcattatcaatcattgaccatcctaacatccttatagagagtatgttagttttccggtcaccgtgagtgagaggataaggcgcagtgtcgtcaatgacagtgaataatgacgagaaaccgccagcccgtatttaagaatttacacgcagcgaacggtgctacacttgtatgtagcgcatctttctttacggtcaatgagcaaggtgttaaattgatcacgttttagaccattttttcgtcggtattagataaaaatatgcaggcgagaaagggtaacggttatttttgacatacggtttatcccgaatggcgacggtcaagtactgacctgcaccatgacgggtagcaacatcaggcgatacgtcttgtacctctatattgagactctgaaacagagactggatgccataaatcaactgcgtgtggatcgcgcgcttgctgccatgggacccgcttttcagcaggtttacagtcttctgccgacattattgcactatcaccatccactgatgccgggttaccttgatggtaacgttcccagcggtatttgcttctacacgcctgatgaaacccaacgccactatctgaacgaacttgagctgtaccgcggtatgacgccgcaggacccgccgaagggcgagctgccgattaccggcgtttacaccatgggcagcacctcctcggtcgggcagagctgctcgtccgacctggatatctgggtgtgccatcagtcctggctcgacggcgaagagcgtcagttgctgcaacgtaagtgtagcctgctggaaagctgggccgcctcgcttggcgttgaggtgagcttcttcctgatcgacgagaaccgtttccgccataacgaaagcggcagtctgggcggggaagactgtggttctacgcagcatatcctgttgcttgatgagttttatcgtaccgctgtgcgcctggccgggaagcgtatcctgtggagtatggtgccgtgcgacgaagaagagcattacgacgactatgtcatgacgctctatgcgcagggcgtattaacgccaaacgaatggctggatctggggggcttaagctcgctctccgccgaagagtactttggcgccagcctgtggcagctatacaagagcattgactcgccgtacaaagcggtgctgaaaacgctgctgctggaagcctattcatgggaatatcctaacccacgtctgctggcgaaagatattaaacaacgtctgcatgacggtgaaatcgtatcgtttggactcgatccctactgcatgatgctggaacgggtcactgaatacctgacggcgattgaagatccgacgcggctggatttagtccgccgctgcttttacctgaaagtgtgcgagaaattaagtcgcgagcgtgcctgcgtaggctggcgtcgggaagtattaagccagttagtcagcgagtggggatgggacgacgcgcgtctgaccatgctcgataatcgcgcaaactggaaaatcgatcaggtgcgcgaagcccacaacgaattgctcgacgccatgatgcaaagctatcgtaatctgattcgctttgcgcggcgcaacaacctcagcgtgagtgccagcccgcaggatatcggcgtactgacgcgtaagctgtacgcggcttttgaagcgttgccgggtaaagtcacgctggtgaacccgcagatatcgccggatctgtccgagccgaatttaacctttatccatgtgccgccgggacgcgccaaccgttcaggctggtatctctacaaccgcgcgccgaacatggattccatcatcagccatcagccgctggaatataaccgttatcttaataagctggtcgcgtgggcgtggttcaacggcctgctgacgtcgcgaacgcatctgtttattaagggcaacggtattgtcgacctgcctaagttacaggagatggtcgccgatgtttcgcaccatttcccgctgcgcttgcctgctccgacgccgaaagcgctctacagcccctgtgaaattcgccatctggcgattatcgttaacctcgaatatgacccgacggcggcgtttcgcaataaagtggtccattttgacttccgtaagctggacgttttcagctttggcgaagagcaaaactgtctgataggcagtatcgacttgttatatcgcaactcgtggaacgaagtgcgtactctgcactttaacggcgagcaggcgatgatcgaagcgctgaaaacgattctggggaaaatgcaccaggatgccgcgccgccggatagcgtggaggtgttctgctacagtcagcatcttcgcggcctgattcgcacccgtgtgcagcaactggtctccgaatgtattgagctacgtctttccagcacccgtcaggagaccggtcgcttcaaggcgctgcgggtttccgggcagacgtgggggctattcttcgaacgcttgaatgtctcggtgcagaagctggagaacgctatcgaattctacggcgcgatttcgcataacaagctgcacgggctgtcggtacaggtggaaaccaaccaggtgaaattgccgtcagtggtggatggcttcgccagcgaagggattatccagttcttctttgaagaaacaggcgatgagaaaggctttaacatttatattctggatgaaagtaaccgggcggaagtatatcaccactgcgaaggtagcaaggaagaactggtgcgcgacgtcagtcgcttctattcgtcatcgcacgatcgcttcacgtatggctccagttttatcaactttaacctgccgcagttctaccagatagtgaaaaccgatggccgcgcgcaggtgatcccattccgtacgcagcctatcaacaccgtgccgccagcaaaccaggatcatgacgcgccgctattgcagcagtatttttcgtaagtgctgcgccgggcaaagctgcccggccggcgttcaccgcttcacattaacttcacccaacttcgttaccgtgacctccgcatttggtttacaggaggaggtttgaggtggcagatgcgttcattttgttagggatagtcatggcgatggtcagcctcggcttcattcttataaataagttattctgttttatatctgctgggtgcctgctctcgttatgcgccagcatggccagttttcaactctgggatgcatcttactgggggcgatggggaaaagtatgtcccggcctggatgtgatcatctcctgcgacaattaccattttctctatgacttgggatgggaattgtacggtatcgcctttttgttctttaccgcgttaatgctcacatgtgcggccattattcttatcaatatgattatggctttagagcgatactgtgccggatggcggcgctaacgcgccttatccagcctacattcgaagaatgctcattgagcggaacaaggtttagataatattttttcttatacaatttatgtagtaatattcagaccgttcaaaatgctatcgcgtccttcattgttttcgtaaatatgttttgaaaaactatattagaaacaaaagctctttaatggtttcttatggatgtttttataaaaggatattatatgtcaataaacaaccctattcttatttgcgtgaataagaaacgacaaataaaattagctctgttttattcagtggtagctatagctcttatgatgagcctctttctaaattatagtattatgctaaagatggtgtgtgtttttttaatactcctcatgatagcaggcgcaagtgcttactggtactccgccttttcaggaaagccacagctaacgttgaaccaggagggagtaacattacacacaaccaggctaccaatagtttactggcatgaaatcgactatgttggtgagcgtgttagcgataatacgcctgtgctggccatttttgtcaaagatgttgagctttattgtcagcgaattactaatgagaaaatgcgtaataattttctgtcattattgaataagcatgaaagtaatcgcgtgatgaatatctctctaaacgatctcgattatgactcagatgagttacaggatatttttaaaatggctgttgccagaaacctggaacaatagggtagagatatatgttttttgttattactcaccatattgatgtgctgcctctggcaaccctacccacacatgaaacatgcccttattgtaataatcaggatgtatggttgattattcgccaaaaaaggacccgtacatgtggtctgtctcaagcgagaaaaagagataagtttggtttagcgatatgcaatcattgcagcaatgaaatcaaggaaaaacgttggtcaccagcgttacgtcaactttttaccgagcagaagccactatttaacctaaccttttggcaacgctacggtttttgggttggttggttgagtgtatggcccgcgctgtttctggcaacctggctgtatttcacatttcggggttggtaatacgaccgcatatctcgttaaatatacgcaggaaagcgctattcttctggctctcctgcggaattaaaacttagcgaaaactcaccttttcacccgcttgttgcgttgccgcctgctccagcagatcccagaaggtttcgccgctgcgatcgcaaacccactcgtcgcctttcagatcgaaatgatagccgccctgtttggtcgccagccacacctggtgcaacggctcctgacggttaataatgatcttactgccgttctcaaagctgagggtcagcacgccgccgttgatttcgcagtcgatatcgctgtcgccgtcccagctatcgaggcgttcttcaatggtgagccacagggcgtcagccaggcgatgaaattcactgtcgttcattgttttatcccgctattgagtgatagcgccagtataaggggaagcgtcagcttctggaaccgatacgaattaccgttgtgagcggtaaaggataaaactcagcggtaggtaaatgacgataaatagcgcaccggtgataagtatgacggacgcgttaaccgggaaatggttcagagccgacagcattgccaccatcagtgcgacgcagccgccgcagaggagaaaatgcaacaggattaagggggcgcgcggctttgctttgatatccaaaagagcgctaagcagaccgagtaccgcgcttatcgtcaggactccggcagcttcaacaccgtttatcgtgccgtgcataatgctttcaataatgacgtaaatgcatgaaccgatccccacgccccgaagggcgtttttcaaatgtttaatcaagtgcgcaaaacggtttagcggcgtcatttttggcattccggtgcctgcgttatgatgatgatgtctttattgttggtgtacatgacgttcctattcagagtatgcgtcttatccgggcagggggatgctgttcggtaaagctggctgccaatccacgtataaactagcggttgtcatacgcaaaacgctcggtgacttttagcggcccattgatgctaaagacatgaataccctgaccttgctggctatcacgcataaaatagccatgctcttttccggcgttaatttcccggttcaggaagggggttgcgctatccagttccagccctgagttgccgggttaatcaatgaattgggtaaccgacgcaggcgtttgaaactcacctccggcaacgaaagattgttctcctcttctggctggagataaaccacgccgctgccttgccgctgataaacattgtgcggagattcactcagccggcatccccaggcgggaggcagcagaagtgaaagcgaaaaaaggcaaaacaaattacgatattgcataaggtcatccggacgtggtacgtaaacctaaagtgatgagcaaagcatgtttcctgatgtaaatgcgcaataatcatggcaacgcgccgcttttcagattttataaagagcccctaaacgcttgcttttacgccttctcctgcgatgatagaaaatagaaagcatgaacttacaggcaatccataatgaaaaacgtgtttaagacactcgctgtacttctgactctgttcagcctgacgggctgcggtttgaaagggccgctttatttcccgccagccgataaaaatgcgccgccgccgacgaaaaaagtcgattcgcaaacgcagtccacgatgcccgataagaacgatcgcgcaacgggagatggcccgtcccaggtcaattactgaggatagttttctgtccccgcgtgaacggagtgaatgatgcaattctctaaaatgcatggccttggcaacgattttatggtcgtcgacgcggtaacgcagaatgtctttttttcgccggaactgattcgtcggctatccgacagacacctgggcgtagggttcgatcagctgctggtggttgagccgccctatgatcctgagttggactttcattaccgcatcttcaacgccgacggcagtgaagtctcgcagtgcggcaatggcgcgcgctgtttcgcgcgatttgttcgcctgaaagggctaaccaataaacgcgacattcgggtcagtaccgcgaatggccggatggtactgagcgtcacggaagatgaactggtgcgggtgaatatgggggaaccaaactttgaacccgcgcaggtgccttttcgcgccaacaaagcggaaaagacgtatattatgcgagcggcggaacagaccatactgtgcggcgtggtttcaatgggcaatccgcactgtgtcattcaggttgataacgtcgacacggcggccgttgaaacactggggccggttctggaaagccatgagcgttttccggaacgcgccaacattggttttatgcaggttgtaagacgtgagcatatccggctgcgagtctatgaacgcggcgcaggggagacccgcgcgtgcggcagcggcgcgtgcgctgccgttgccgtggggattcagcaggggctgctggctgaagaagtacgcgtggaattaccgggcggtcggctggatatcgcctggaaaggtccgggtcatccgttatacatgactggtccggcggcacatatctacgacggatttatccatttatgaagcaaccagaggaagaactacaggaaacgctcacggaactggacgatcgagcggtcgtcgattacctgcgccaccaccctgagttttttatccgtaacgcccacgccgttgaagcgatgcgtgttccacatcccgtgcggggaacggtttcgctcgttgagtggcatatggcccgcgcgcgtaatcacatcaatgtgcttgaagaaaatatgacgctgctgatggaacaggctcatgccaatgaaagcctgttttatcgcttgctgcatctgcaaagccgtctggtcgccgcggatagtctggatgagatgctggtgcggtttcaccgctgggcgcgcgatttggggcttgccggcgcgacgctgcgtttgttcccggatcggtggcgtcttggcgcgccatcgcgctatacacatctggctttaaaccgtcaggcctttgagccgctgcgtattcaacggctgggacagtcgcagcattatcttggcccgctaaacggcccggaactgctggtggtcttgccggaggcgaaggctgtaggctcggtagccatgtcgatgatgggcagcgatggcggcctcggggtgattctcttcagcagccgtgacccgcatcactatcagccgggacaggggacgcagcttttacaggagatcgcgctgatgctgccggaactgctggaacgctggattaaacgcgtatgacggatgtcgcgctttctcaggatgtctcgcggttcctgcgctatttaggcgtggagcgccagcttagccccattaccctgctgaactaccagcgtcagcttgatgccattatcgctttagccggagaaaccgggctgaaaagctggcaacaatgtgacgctgcgattgtgcgcagttttgcggtgcgcagtcggcgcaaagggcttggccctgccagtctggcgctacgtctctcggcattgcgaagcttttttgactggttagtcagtcagggcgaattgaaagctaacccggcaaagggtgtctccgcaccgaaagcgccgcgtcatctgccgaaaaatattgatgtcgacgacgttaaccgcctgctggacatcgatcttaacgatccgctcgccgtacgtgatcgggcgatgctggaggtcatgtacggcgcggggctgcgtttatccgaactggttggcctggatataaagcacctcgatctcgataccggagaagtgtgggtaatgggtaaaggcagcaaagagcgacgcctgccgattggccgtaacgcggtgacgtggattgagcactggttggatctgcgcggcctgttcgccagcgatgaagaggcgttattcctgtcgaagctcggcaagcgtatctccgcgcgcaatgtccaaaaacggttcgccgaatggggcataaagcaggggctaaacagccacgtgcatccacataagctgcgccattcgttcgcgacccatatgctggaatcgagcggcgatctgcgcggcgtgcaagagctgctgggtcatgccaacctttccaccacccaaatttatactcatcttgattttcaacatcttgcttcagtgtacgacgcggcgcatccgcgcgctaaacgggggaaataatgcgtttttaccggcctttggggcgtattgccgcgctcacctttgacctggatgataccctttatgataaccgtccggtgattttgcgtactgagcaggaagcgctcgcttttatgcagaattatcacccgtcgctacgttcgtttcaaaacgtcgatttacagcggatacggcaggcggtgcgtgaagcggagccggaaatctatcatgacgttacccgctggcgccatcgcgcgatagagcaggccatgcgggatgcgggattatcggcgcaggaggccattgccggcgcgaatgcggcgatgatgcattttgccaaatggcgcagccagattgaggttccgcaggctacccatgagacgttacagcagcttgcgaaaaaatggccgctggtggcgatcactaacggcaatgcccagccggaactgtttggcctcggcgattactttaagtttgtactgcgcgccggcccggatggacgttccaagccctttagcgacatgtatttcctggcggcggaaaaactgcatgtgccgatcggcgagatcctgcatgtcggcgatgatctgactaccgatgtggctggcgctattcgctgtgggatgcaggcctgctggattaaacctgaaaatgccgacctgatgcggacgcaggacagccgtttactgccgcatatcgaaatttcgcggttggcatctctcacctcgctgatataatcaccagtagttctgtataaattcccagttattctggcggatggcgctatgcttatccgccctacgataagtagccccggtaagcgaagcgccaccgggcgtttttagttttcatgtttttacgcggcggtgccaatggacgtttcttacctgctcgacagccttaatgataaacagcgcgaagcggtggccgcgccacgtagcaacatgctggtgctggcgggcgcgggaagcgggaaaacccgcgtgctggtgcaccgtatcgcctggttactgagcgtagaaaacaactcgccatattccatcatggcggtgacctttaccaataaagcggcggcggaaatgcgccatcgtattggccagttgatggggaccagccagggcggaatgtgggtagggacgttccacggtctggcgcaccgcctgctgcgcgcgcatcatatggacgctaatttgccgcaggatttccagattctcgacagcgaagatcagatgcgtttgcttaaacgcctgattaaggcgatgaatcttgatgagaagcagtggccgccgcgtcaggcgatgtggtacatcaatagccagaaagacgaagggctacgcccgcaccatatccaaagctatggcaacccggtggagcagacctggcagaaggtgtatcaggcctatcaggaagcgtgcgatcgcgctggtctggtggattttgccgagctactgctgcgcgctcatgaactatggctgaacaagccgcacatcctgcaacactatcgcgagcggtttactaacatcctggtggacgaattccaggataccaacaacattcagtacgcctgggttcgtctgctggcgggcgataccggtaaggtgatgattgtcggcgacgatgaccagtcgatctacggctggcgcggggcccaggtagagaacatccagcgcttcctcaatgatttccccggcgcgcagaccattcgtctggagcagaattaccgctcgaccagcaacatccttagcgcggcgaacgctctgattgagaataacaatgggcgtttgggtaaaaagctgtggactgacggcgttgacggcgaaccgatatcgctgtactgcgctttcaacgaactggatgaagcgcgctttgtggttaaccgtatcaaaacctggcaggacaacggcggcgcgcttgcgcaatgcgccattctttatcgcagcaacgcccagtcgcgcgtgctggaagaagcgttattacaggccagtatgccgtaccgcatttacggcggtatgcgcttcttcgaacgccaggagatcaaagatgcgctctcttatctgcgtttgattgccaatcgcaacgatgatgccgcctttgaacgcgtggtgaataccccaacgcgcggtatcggcgaccgcacgctggacgtggtgcgccagacctcgcgcgatcgccagctaacattgtggcaggtgtgccgtgaattgttacaggaaaaagccctggccgggcgtgcggccagcgcgctgcaacgctttatggaactgatcgacgccctggcgcaggaaaccgccgacatgccgctgcatgtgcagactgaccgggtgatcaaagattccggcctgcgcaccatgtatgagcaagaaaaaggcgagaaaggccagacgcgcatcgaaaacttagaggaactggtgacggcaacgcggcagttcagctacaacgacgaagatgaagatttgatgccgttgcaggccttcctctctcacgcggcgctggaagcgggcgaggggcaggcggatacctggcaggatgcggtacagctgatgacgctgcactcggccaaaggcctggagtttccgcaggtgtttatcgtcgggatggaagaggggatgttccccagccagatgtcgctggatgagggcgggcgtttggaagaggagcgtcgtctggcctacgtcggcgttacccgtgccatgcagaaactgacgctaacctatgccgaaactcgccgtctgtatggtaaagaggtttatcatcgcccgtcgcgtttcatcggcgagttgccggaggagtgcgtggaagaggtccgtctgcgcgccaccgtcagtcgtccggtgagccatcaacgaatgggaacgccgctggcggaaaacgacacaggctacaaactcggccaacgcgtgcgccatgcgaagttcggcgagggaactattgtcaacctggagggcagcggcgagcatagccggttgcaggtggcttttcaggggcaagggatcaaatggctggttgccgcgtatgcgaagctggaaacggtttgaccgactctcatagtgccggatggcgcgtcttatccggcctacgcgctggctaacattttgatttgtaggccggataaggcgaagccgccatccggcgatatattgatgttaatattctgaaatcatagataaatactctcactctgctaacctttctgcataaggggaaattattgctttttcgcgtttcgttgcgtgttgacggcaaatttttgctggcgtaacatgcgcccacgattacgctaagaggacattcgccttggacacacccagtagatactggctcattatcctgtcatccaggatcaactcctaaggctatccctttttgctgatagccttagcggttgtcagcgacctttcattttttcccgtcgcgttgagtcaggctgtttaatggtctgaaacccaatttgtttctgtgtgcccatctgaactgtccgatatttttacgcattgggagtcccggtcatgctgagcgcatttcaactggaaaaaaaccgactgacccggctggaagtcgaggagtcacaaagcctgattgatgccgtatgggtcgatttggtcgaaccggacgacgacgagcgattgcgcgtacaatctgagctgggccagagtctggcgacgcgtcctgaactggaagatatcgaagcatccgcgcgcttctttgaagacgaagacggactgcatatccactccttcttcttcttcgaagatgcggaagatcatgccggtaactctacggtggcattcactattcgcgatggccgtctgtttacgctgcgtgaacgcgaactgcccgccttccgtttgtatcgtatgcgcgcccgcagccaggcgatggtcgacggtaatgcttatgaattactgctcgatctgttcgaaactaaaattgaacagttggcggatgaaatcgaaaacatctacagcgatctggaaaaactgagccgcgtcattatggaagggcatcagggcgatgaatacgacgaagcgctctccacgctggcggaactggaagatatcggctggaaggtacgcctgtgtctgatggatacccaacgcgcgctgaacttcctggtgcgcaaggcgcgcttaccgggcggacagctggagcaggcgcgtgagatcctgcgcgatatcgaatctctgctgccgcacaatgaatcgctgttccagaaggtgaacttcctgatgcaggcggcgatgggtttcatcaacatcgagcagaaccgtattatcaaaatcttctcggtggtttccgtggtgttcctgccgccgacgctggtcgcttccagctatgggatgaacttcgagtttatgccggaactgaagtggagctttggttatccaggcgcgattatctttatgattctggcggggcttgcgccgtatttgtactttaagcgcaagaactggctgtaagacattaaggccagggtgattcagctgcggctgaaccaccctgaaaagttacaggctccaggtattgatacctttaacctctttttcatagaaccacttatttgtattgacgccgacataagctgcgacaacaagtccaagtatgttaacgccgattaatgctccaataaatattgcaacgatccctaataaaataactataattgcttttttccacagacccagtacaaacaaataaatccatgagaagaaaaaggcaataaagtttatttgaatagtcaaccgttgtcggggctttaatgctttaaatgcctgtttatattctgggcttactttccaaaatccagggaaaccatgttgatcgtaaaatgaaaaacggtatttccatttttcagatagcgaaccatcattaatataatccttgtccatgtaaactccattaaattacttgttgagtgaattcgaatccgggggggccagaagtagcagagaaaaggttgcaaaataccagattagaaaaagaggcataccaaagccatcgcaagcgaaatcttcagcaaccattatcacgaaggaggcaatatagattacaagcgtaccccatacatagaattttatatattcaaagccactgtctctgaatcgctgacagtttaaattaatgacgagataatgtagtaaaattgtgaataaaattgccagtatcacaaagcttaaatataataaaaccccaaccaaaatggaaaatattatatttattagcgcgaatgataataaataacgacatctggaaacacatctctcagatgaaggaataaaaacacttaacattaatttcacatccatatgttgggttacgtcgttagcatgacaatatgctaccccccttacaaggggaggcatattttttcagattatatttagaataatagtcgcgttattttttacgctgcgtataaatcgcatccatcacgaaaatcgccagcgcgacccagataaacgcaaatgtcaccatcttatccgcgcccggcacttcgccataaaacgtcaccgccagtaaaaacatcagcgttgggccgatatactggaaaaagcccagtgtagaaagacgcagacgcgtagccgctccggtgaagcacagcagcggaatcgtagtgaccacacccgccgccattaacagcaagttcaacgatagtgcgttttgccccatatggctggtagggctatcggcgatgccaaacagataaatcgcggcgaccggcaacagccatagcgtttcaaccagcatacccgtctgcgcttcaacggcgatcttcttacgcaccaggccgtaaaacgcaaaactaaacgccagccccagcgcgataatcggcagcgagccaaaggtccagagttgcaccagcacgccgcacaccgccagaatcaccgccagccactgcattcgacggaagcgttcgccaagaaaaatcatccccagcaagatgttaaccagcggattaatgaaataacccaggctggcctccagcatatggtgattatttaccgcccaaatgaacaatagccagttaccgccgaccagtacggcggacagggccagcaggaaaatcttctttggcgttttcagtaagcgcttaacctgtcgccactgccggctgacgctaagcagcgccaccataaagaaaaatgaccaaatcacgcggtgcgtcaggatctcatctgcgggaacgtaatagatcagcttgaaatacgcgggggcgatcccccaaataaaataggcggcaagagcgagtaatacgccctgccgtgtttgttttgcgtccatccggaaaactcgtatctgaagtgtaacaacagtttacctgcttttatcccaccatataagtagcggtggcgctggcgatgtacagctgatcttcattgtgtaattccacgcgggcgacggccactttattccctgcgcgcagcaggctactggtggccgtaaagcggttgcctctgcccggacgcaggtaatcgacgcgcaggtcaatcgttcccatccgcgacaggcgctggcgtagttcatcttcgctgatggtttcgtggcgagttagcgtgctgccgacgcataccagtccggcggcgacatccagcgcagaggcgatcacgccgccgtgtaaaatgctttgcgcccagttgccgaccatcatcggctggttgttgaaggccagttgggcgaacgctttttcatagcgttccagctccagccctaacgcccgattaaacggcatgtggtagacaaacatttcacccactaatttcagagcttgttcagcggtaagtacagcggacatagattcctgacacctcattagttaatgaaatgttgatattatgcttcttaattgttgttttctactttaagaagggataactaacggctatgtgtgtaaatatgtaaaaatggttggcagagaatgattcaagctgaaaatacttcgtcaggagaacgtcaagaatgcgggcgattttgagagggttgttgccagccacgctactgccattagcggcatatgcacaagaagctacgataaaagaggttcatgatgcgcctgcagtacggggaagtatcatcgctaacatgctacaggagcatgataacccttttacgctttacccttatgacacgaactacttgatctacacgaacaccagcgatctgaacaaagaggccataagtacctacaactggtctgaaaacgcacgtaaagatgaagtgaaatttcagttgagcctggcgtttccgctgtggcgcggaatactggggccgaactcggtactgggcgcttcctatacgcagaaatcctggtggcagctttccaacagtaaagagtcttcgccgtttcgcgaaaccaactacgaaccgcagctttttcttggttttgctaccgattatcgctttgccggctggacgctgcgcgacgtagagatgggctacaaccatgactctaacggacgttcggaccccacctcgcgtagctggaaccgtctgtatacccgtctgatggccgaaaacggtaactggctggtagaggtcaaaccgtggtacgtgattggcagtaccgatgataatccggacatcaccaaatatatgggttattaccagcttaaaatcggttatcacctgggcgaggcggtattaagcgccaaaggccagtacaactggaatacaggctacggcggcgcggaagttggattaagctatccggtcactaaacatgtccggctttatacccaggtgtacagcggctatggcgaatcgctgatcgactataattttaatcagacacgtgtcggcgtcggcgtgatgcttaacgatatcttctgattggattgtgttttaaacattgcagtttctctcgcaggcgctgaaaatagcgcctgttttgatttatggtgaacggggttaatgtggcgcaggcggaagtgttgaatctggaatcaggggccaaacaggttttgcaggaaacctttggctaccaacagtttcgcccgggtcaggaagcgattattgatactgcgctctccggtcgcgactgtctggtcgtcatgcccaccggcggcggcaaatctctgtgctatcaaatccccgcgttgttgctggacgggttgactgtcgtcgtttcgccattaatctcgttgatgaaagaccaggtcgatcagctactggcgaacggtgtggcggcggcgtgcctgaactccactcaaagccgcgagcagcagcttgaggtgatggcggggtgccgtaccggacagattcgtctgctgtatattgcgccggaacgcctgatgctggacaactttcttgatcatctggcgcactggaatccggtattgctggcggtggatgaagcgcactgtatctcgcaatggggacatgatttccgtccggaatatgcggcgctcggtcagcttcgccagcgttttcccgctttgccgtttatggcattgaccgccaccgccgacgacaccacgcgccaggatattattcgtctgcttgggcttaacgatccgttaatccagattagtagctttgaccgaccgaatatccgctacatgctgatggagaagtttaagccgctcgaccagttaatgcgctatgttcaggagcaacgcggcaaatcgggtatcatctactgtaacagccgggcgaaagtggaagataccgctgcgcgcttgcaaagtcgcggcattagcgcggcggcctatcatgcggggctggaaaacgctattcgcgtcgatgtgcaggaaaaatttcagcgcgacgatctgcaaatcgtggtggcgaccgtcgcttttggaatgggcataaacaaacctaacgtacgtttcgtcgtgcatttcgatatcccgcgcaatattgaatcctactatcaggaaacgggccgcgccgggcgcgacggactgcctgcggaagccatgctattttacgatccggctgatatggcctggctacgtcgttgtctggaagagaaaccagccggacagcttcaggatattgaacggcataaactgaatgcgatgggcgcttttgctgaagcgcaaacctgccgccgcctggtattgcttaattactttggcgaaggccgacaagaaccgtgcggcaactgcgatatctgtctcgatccgcccaaacaatatgatggcttaaacgatgcccagattgcgctttctaccattggtcgggttaaccagcgttttggcatgggctacgttgtcgaggtgatccgcggcgcgaataaccaacgcatccgcgatttcggtcatgacaaactcaaggtttatggcatgggacgcgaaaagagccatgagcactgggtgagcgtgattcgccagctcattcatctggggctggtaatgcaaaatattgcgcagcactccgcattacagttgacggatgccgcgcgtccggtactccgtggagacgttccgctaaagcttgcggtgccgcgcatcgtcgccctcaaaccccgcgtgatgcagaaatcgttcggcggtaattacgatcgcaaattgttcgctaagttgcgcaagctgcgtaaagctatcgctgatgaagagaatatcccgccgtatgtggtctttaacgacgccacgttgatagaaatggcggaacagatgccggtttccgccagcgagatgttaagcgttaacggggttgggatgcgcaaactggagcgcttcgggaaagaatttatggcgctcatccgcgcgcatgtcgatggtgatgacgaagagtagtcagcccggcaaaaaagtgccaggatggtgactcactgaactatttccccgcgagccatttttatgatgatgctatttttcaccgtggcaatggtgcacatcgttgcgctaatgagccccggccccgactttttcttcgtgtctcaaactgctgtcagccgttcgcgtaaagaagcgatgatgggcgtactgggcatcacctgcggcgtgatggtatgggcgggcgtggcgctgcttggcctgcatctcatcatcgaaaaaatggcctggctgcatacgatcattatggtaggcggcggcctgtacctgtgctggatgggctatcagatgctgcgcggcgcgctgaaaaaacaggatgcggcggcgtcttctccgcacattgaactggcgcagagcgggcgcagctttctcaaagggctgctgaccaatctgtcgaatcctaaagcgattatctattttggttccgttttttcactttttgtcggcgataacgtcggcgctgcggcgcgctggggtattttcgcgttaatcaccctggaaacgctggcctggtttaccgtagtcgccagcctgttcgcgctgccgaaaatgcgccgtggctatcagcgtctggcgaaatggattgatggctttgccggcgctctgtttgcgggctttggtattcacctgattatttcgcgctaatttacctccgggccggataaacatcatccggcacgactatcacgcgtgtcttgccgacgccaggagcgcgcctaccagcataaacaacgaaccaaacgctttattcagcgccttcatctgctttggtcctttaatccaggcggcaatgcgctgcgccagtgtggcgtaaccggtcatcacaaccatatccaccacaatcgtggtgacgccgagaatgaggtactgcgccagttgcggttgctgcggcatgatgaattgcggaaacagggcggcaagaaagacaatacttttgggattggttagattgacaaatatcgcccgtttgaacagccgaccccgcgattgcgtctgggcgagggtatgcagatcgatagcgcctgcggcgcgccattgctggatacccagccagataagataagccgcgccagcccatttcagaatttcaaaagcgaggagcgagcgcgaaaagagcgtacccagtccgacgcccaccagtacgatatgtatccccagcccggtctggagtccggcgatagaagccactgcgccacgatatccatggttgatagacgtcgtcatggtattgatggcgcctgaacccggagaaagactcagcagagttgaggtcagtagataggcgaaccaccattcaaaggtcatgcgaaactccctggttgtctgtttttgtgccacaatacgctactgccgctgtgttgtgtcaggcacgacgcaaaaaacgattttacctggtaaacgaggccgaaaacccgatgtttcagcagcaaaatgactgggaaacaagagaaaatgcgtttgccgcttttgctatggggccgctgaccgatttctggcgtcagcgggaagaggcggagtttatcggcgtgggtaacattccggtgcgctttgtccgttttcgaaatgattccaacgatcggacgatcgtcatttgtcctggccgcattgagagttatgtaaaatacgctgaactggcgtatgacctttttcatctcggttttgatatcttcatcatcgaccaccgtggtcaagggcgctccgggcggatgttatcggacccgcatcggggtcatgtcgatcattttaacgattatgttgaggacttagcggcgttctggcagcaggaaattgagccggggccgtggcgtaagcgttatatcctggcgcactcaatggggggcgcgatagccaccctgttcctgcaacgccatcgtgtgcggtgcgacgctattgcgctcaccgcgccgatgtttggtattgtgatacgcttgccttcctttatggtgcgccatattctcgactgggccgaagggcaccagcgtatccgtgaagattacgctattggtaccggtcagtggcgggcgttgccgtttgggatgaatgcgctgacccacagccgccagcgttatcagcgcaacttacgattttatgccgacgagccgcagctgcgcgttggcggccccacctggcattgggtacgcgaaggcattctggcgggtgagcaggtactggctggggcgagcgatgacacgacgcctacgctactgattcaggcggaagaagagcgggtagtggataaccgcacccacgatcgtttttgtgaaattcgcgccgcggcgggatacccttgtgaagggggaaaaccgctggttatcaaaggcgcgtaccatgagatcctttttgaaaaggacgccatgcgctcagtcgcgcttaacgccattgttgaatttttcaacaagcctaatttatccagcggaaatcgctttgcttagaggttaaattttattatgtatcaggttgttgcgtctgatttagatggcacgctgctctcccccgaccatacgttgtccccttatgccaaagagactctgaagctgttgaccgcacgcggcatccattttgtctttgccactggtcgtcatcatgtcgatgtagggcaaatccgcgataatcttgaaatcaagtcttacatgatcacctccaacggcgcgcgagtgcacgataccgacgggaatttggtttttacgcataatctggacagcgacattgccagcgacctgttcggggtggtgaatgcgaacccggacatcgtgactaacgtttatcgcgacgacgaatggtttatgaatcgtcatcgccccgatgaaatgcgttttttcaaagaggcggtatttaactactcgctgtttgagcctgcgctgctggagccggagggcgtcagcaaagtgtttttcaccagcgacactcatgaaaagttgttgccgctggagcaggcgattaacgcgcgctggggcgatcgggtaaacgtgagcttctctacgctaacctgtctggaagtgatggcgggcggagtgtcgaaaggtcatgcgctggaagcggtcgctcaggcgatggggtacagtctgaaagagtgtatcgcctttggcgacggaatgaacgacgctgaaatgctcacgatggcgggcaaaggctgcatcatgggcaatgcgcaccagcgtctgaaagacctgtatcccgaacttgaggtgatcggcatcaacgcggataacgccgtgccgcattacctgcgcgatcttttcttacgctgatgtgattgtttgttagttgaccagttgtcaacttcactctccgctacaatgggtgttccctgttttaagagacatccattgtggcgctactcatcattaccactatcctgtgggctttctcctttagtttatttggcgagtatcttgccgggcatgtcgatagctatttcgcggtgctgatacgcgttgggctggcggcgctcgtttttctgccgtttttgcgtactcgcgggcacaacctaaaaaccatcagcctgtatatgctggtgggggcgatgcagcttggcatcatgtatatgttgagcttccatgcttacctctacctgaccgtatccgaactgctgttgtttaccgttctgacgccgctctatatcacgctgatttacgatgtgatgagtcagcgtcgtttgcgctggggctatgcatttagcgcgttgctggcggtgattggcgccgggattattcgctacgatcgcgtgaccgaccatttttgggtcggtttgctcctggtgcagctttctaatatcagtttcgctatcggaatggtggggtataaacgtctgatggagacccgtcccatgccgcagcacaacgcctttgcgtggttctatctgggggcgtttttggtggcggcggtggcgtggtcgctgttggggaacgcgcaaaagctgccggaaaccacgctgcaatggagcattctggtgtttctcggcgtggtggcgtcaggcattggctactttatgtggaactatggcgctacccaggtagacgccgggacgctgggtatcatgaataacatgcatgttcccgcaggactgctggttaatcttgccatctggcatcagcagccccactggccaagctttattacaggcgcggctgtgatcctggcttcgctgtgggtgcatcgaaaatgggtcgctccgcgctccgcacaaacggcagatgatcgcaggcgtgatcccgcgtcgagcgaataaacgcctcggtcaccgcctgacgctggtcgccgtcgcgcacggcggcatacaggcggctccacagaccatcgccaagggttttggtcaccaccagaccctggcgctcaacgctttccaccacccagtgcggcagggcggcaatacccattctggccgccaccatctgaatcagcagtagcgtattatccacgcttttcagcagcggactgatacccgccggttgcaggaaatgtcgccagacatccagtcggctgcgctgcaccgggtaaatcaacagcgtttcgctggctaaatcttccggcgtaatctgcgttttgctggccagcggatggtcgggcgccagcaccagtcggacttcaaaatcaaacatcggcgaataatgcagtccgctacgcggcaaaatatccgacgtcatcaccaaatccagctcgccttgttgcaaggccggttgcggatcaaaagtgacgccggaggtgaaatccatttctacctgcggccagcttgcacggaagttttccagcgccggggtcagccactgaatacagctatgacattcaatagcgatgcgcagacgagtttgctgcggttcgttgcacgcctgcagcgcacggctgatttgcggcagcacttggtttgccagttgcagcagaacttccccctgcggcgtaaagcgcagcggctggcttttacgcacgaacaggcggaagccaaggcgttgttccagatcgctgaactgatgagacagagcggattgggtctggtgcagcaccgccgccgcggcagccagcgatccactattccgcaatgcctggagtgttttcagatgtttaatttcgatcatgaaagtccttcacttcgccatgaacaaattgcgcttgaggaatatacagtacctttacattatggatgtgtaaacatccagacgtctaaaactcgtcatatttcgacttgcagatgcgttggcttccttgcttaccccagtcacttacttcagtaagctcctggggatgcgctgtgtcgccgccttcctgcaagccgaactatttagagttttactttcagattcaataaaataagagaggaagtaaaatgacaatattgactcataccctcggttttcctcgcgttggcctgcgtcgcgagttgaaaaaagcgcaagagagctactgggcggggaacacaacgcgtgaagcgttactggcggtggggcgcgaactgcgcgcgcgtcactgggagcagcagaaacaagcgggtattgacctgttaccggtaggcgactttgcctggtacgaccatgttctgaccaccagcctgctgttaggcaatgtgccggctcgtcatcagaacaacgacggttccgtggacatcgacactctgttccgcattggccgcggtcgcgcgccaaccggcgaaccggcggcggcagcggaaatgaccaaatggtttaatactaactatcactacatagtaccggagttcagcaaaggccagcagttcagactcacctggacacagttgctggaggaagtggacgaagcgctggcgctggggcataagatcaaacccgtactgctggggcctgtcacgtatctgtggctgggtaaagtgaaaggcgagccgtttgaccgcctgacgttgctgaaagacattttgccggtgtatcagcacgtactggctgaactggcaaaacgtggtattgagtgggtccaaattgatgagccagcgctggtgctggaactgccgcaggcgtggctggatgccttcaaaccggcttacgacgcgctcgccggccaggtgaagctgttgctgacgacctattttgaaggcgtgacgccaaacctggacactattatcgcgctaccggtacaggggctacatgttgacctcattcatggcaaagatgatgtagcggaactgcatcaacgtctgccggtcgactggctgctctccgcaggcttgattaacgggcgtaatgtctggcgcgccgatttgaccgaaaaatacgcgcagattaacgccattgtgggcaaacgcgcgctgtgggtagcatcctcctgctctttgctgcacagcccgatcgatctcagcgtcgaaacgcgtctggatacggaagttaaaagctggtttgcctttgcgctgcaaaaatgcggtgaactggcgttgctgcgcgatgcgctgaacagcggcgaaacggcggcgcttgaggaatggagcgcaccgattcaggctcgtcgtcactcccgccgcgtacataatgccgcggtagaaaaacgcctggcggcgatcaccgcgcaggacagccagcgtgagaatccgtatgaggtgcgcgctgaagcgcaacgcgcccgctttaaacttcccgcctggccgacgacgactatcggttcgtttccgcaaaccacggagattcgcggtctgcgtctggacttcaaaaagggcaacctcgacgcgaaccactaccgcaccggcatcgccgaacatatcaaacaggctatcatcgagcaggagcgtttagggctggatgtgctggtacacggcgaagccgagcgaaacgacatggtggaatacttcggcgagcatctggacggcttcgtctttacccagaatggttgggtgcaaagctatggctcccgctgtgtgaaaccgccggtagtgattggcgatatcagccgtccggcaccgattaccgtggagtgggcgaaatatgcccagtcgctgaccgacaagccggtaaaagggatgttgaccggcccggtgactattctttgctggtcattcccccgcgaagacgtgacccgcgaaacgattgcgaaacagattgcgctggcgctgcgtgatgaagtcgcggatctggaggcggcggggatcgggattattcagattgacgaaccggcgctgcgtgaaggtttaccgctgcgtcgcagcgactgggacgcctatctggaatggggtgtggaagccttccgcatcaacgcggcggtggcgaaggatgaaacccagatccacacccacatgtgttactgcgagttcaacgacattatggattcgatcgccgcgctggacgcggatgtgatcaccattgagacctcccgctcggatatggagttgctggagtcgttcgaagcgttcgactacccgaacgaaatcgggccgggcgtgtacgatattcactcgccgaacgtgccgagcgtcgagtggattgaagccctgctgaagaaggcggcacaacgtattccggcacaacgcctgtgggtgaatccggactgcggtctgaaaactcgcggttggccggaaacccgcgcggcgttagcgaacatggtcaaagcggcgcacaatctgcgtcaggcgaaataacccatcctggccgctgcgtttatccggcagcaatgcggcgctaccctttgacgggtagcgcccgtgcctgacctgattaacagcgcctctatctcctcttttttctcatttccctttttcttattttccgcgctgtctttttcaggatctggctatttggcgatcttgataataaaaaggttctccgtatgaatgacaaccaggcggatagcgtccccggaagcagagcggcggcttttattgcctcgcagatcgtttttcctgtcatgatcgcccagcgctctcatagcacaaaacgaggttttccattctgttatgttccctggcgacgataaacgtcgcattgtctcatggcgctggtgaaccttattttttaacggagatgtctgacatggcggtagcaggttgtcacgtaatggccaaacccggcggcgcgatctgcaatattgattgcacatattgcttctatcttgaaaaagaggcgctgtacccggaacgcaataaaaactggcggatgtcggacgagacgctggaacaatttatacgccagcatattgccgcgcagagtggcgaccgcattgactttgcctggcagggcggcgaaccgaccatgatggggctaccgtttttccgtcgggttgtcgcattatgtgaaaagtacggcgatgggcgaaaaatcactcatgcgttgcagacgaacggcatcctggtgaatgacgagtgggcgcgctttttcgctgaacagcattttctcatcggtctctctatcgacggcccggcgtcgttacacaaccactatcggtttaatcgcgctggaaaaggaactcatgaacaggtcgtcgcagccatggcgcggcttaaagcgcaccatgtcgactttaataccttaaccgtcgtgggaaaacataacgtcggtcatgcagcagacgtctacgaatttcttctggcggcgggatcgcgttttattcagtttatcccgctggtagagcgaatgagcaccgataactcatcggtacttaatctggtgatgcccggcgaaagcgcggcgacgctggcgccatggacggtaccgtcgtggcaatatggcgaatttctcaaccagatctttgatatctgggttcgtcgcgacgtagaccgcgtctatgtgcagatgtttgacgtggcgttagccgcctggacggcgcagcagccggtactgtgtgtacattccgagacttgtggacatgccttcgcgttggagtcgaacggcgatctctacaactgcgaccactttgtctacccggagcatctgctgggaaatatccaccagcacagcatcaaagccttaaataatagcgagcgggctattgcctttggcgaggccaagcgggagaccctgaccgccgattgtcgtcgctgtgactaccgctttgtatgtcatggcggctgtcctaagcatcgctttgccgtctcgccgtctggtcatcctgcgcataattacttgtgtgcgggctataagcattttttccagcacgttacgccgtatatgaatgtctggcgggagctgctggcgcaaggctatccgatggcatcgatcatgcgctggctggcgcaggacgcgcgtaaagacacaggagccgtcagtcgtaaccatccctgtccctgcggcagcggcaaaaaatataaaaaatgctgtggtaaagcatagctaacgtggcgatgacgctttgttgagcctacaccgactccggtctcgtaggcccaacaaacatcgtaatgcgctgtggttagccttttttcccaccgtactgcgcgaaccattccagcattctttgccagccgtctttcgctgaggcttcgtggtagcccggacgataatcggcattaaacgcgtgccctgcatcgggatagaccacgatttccgccttcgcattagcggcgcgtagcgcctgacgcatggtttccacgctctcctgtggaatactggtatcctgcccgccgtataaacccagtaccggcgcgttaagatcggtggcgatatcaacgggatgcttcggcgaattgagtgacgtgtcgcccaccagcttgccgtaccatgctaccgccgcttttaactgtgggttgtgcgcggcgtacagccaggtaatccggcctccccaacaaaaaccggtgatcatcagccgatgcgcatccccgccgttgcgcgaagcccaactggcgacgtgatccaggtcggcaaggacttgcgaatcgggtactttagccaccagcccgctcaataatgtgggtatatcggcgaaatcattggggtcgccttcgcggaaatagagctccggcgcgatagcgagatagccttccagcgccagtcgtcggcaaatatcgcgaatgtgttcatgtacgccaaaaatttcctgtaccacaatgaccaccggcagcgcgccgtcgctcgcttttggtctggcgtaataggcgggcatatcgtcgccctgagagggaatcgacgttatccccgcgctaatggccccatcaggcgtatgaatcatcgtaggggcaagtggggaggctgcaggtgcaaagccggatggatgtgtcgttgtcatggtattctccgtacccttaaaaaatagcgcaatcttaactatagacagtgtgtaacaaaccacattgccttaaagcggctatcttttgtgcaatgcctggcgatattgattatttattgtgatgaacatcactttttaatggtaagcgagtgcaattgttttacgtcatagtgatggctgtcacgaaaatatctttatgccttaggtaaagtgtctctttgcttcttctgacaaacccgattcacagaggagttttatatgtccaagtctgatgtttttcatctcggcctcaccaaaaacgatttacaaggggcccagctcgccatcgtccctggcgatcctgagcgtgtggaaaagatcgccgcgctgatggataagccggttaagctggcatctcaccgcgaattcacctcctggcgcgctgagctggatggcaaagcagttatcgtttgctctaccggtatcggtggcccgtctacctctattgccgtggaagaactggcgcaactgggtattcgtaccttcttgcgtatcggcaccacgggggctattcagccgcacattaacgtcggcgacgttctggtaacgaccgcatccgtacgtctggatggggcgagcctgcattttgcgccgatggaattcccggcggttgccgactttgcctgcaccactgcgctggttgaagccgcgaaatcgattggcgccacgactcacgttggcgtaaccgcctcttccgacactttctatccgggtcaggaacgttacgacacctattctggccgcgttgttcgtcgcttcaaaggctctatggaagagtggcaggcgatgggcgtgatgaactacgaaatggaatccgctacgctgttaaccatgtgcgcaagccagggtttacgcgcaggtatggtggcgggcgttatcgtcaaccgtacccaacaagagattccgaatgcggaaacgatgaaacaaactgaaagccacgcggtgaaaatcgtcgtggaagcggcccgtcgtctgctgtaattctcctctcttttgcaaaggccgacgcgttcggccttttctttttgcgtggcgcctcgcaggaaatcccttttaaactggacgtttatacagcacaattctattttgtgcaggacagtgtggttccaggagaggtgttgtggatattactcttatgataagcgccgtcgtggcgctggcggctggggcggtgattggctggctggcgacgaaagcgcacgccgatcaaatccgcgccgatcttatcgaagaacggcgtgagctggatatcgaacttagcgcggcccggcagcaattagcgcaagaagcgcactggcgcagtgaatgcgagttacttaataacgaactgcgtagcctgcacagtattaatacctctctggaagccgatctgcgtgaagtcacgacccgtctggaagcgactcagcaacacgcggaagacaaaatccgtcagatgatcaacagcgaacagcgtttaagcgagcagtttgaaaatctggcgaaccgtatctttgaacacagtaatcgtcgcgtagacgaacaaaaccgacaaagcctgaatagcctgctgacgccgctgcgtgagcaactggacggttttcgccgccaggttcaggagagttttggcaaagaagcgcaggagcggcatacgctggcgcacgaaattcgtaatttgcagcagcttaacgcgcaaatggcgcaggaagcgatcaacctgacgcgcgccctgaaaggggacaataaggcgcaaggaaactggggcgaagttgtgctggcgcgggtgctggaggcatccggactgcgtgaaggctacgaatacgaaacccaggtcagtattgagaacgatgcgcgctcgcggatgcagccggatgtcatcgtccgcttgccgcagggcaaagatgtggtcatcgacgctaaaatgacgttggtcgcctacgagcgttactttaacgctgaagatgactacacgcgcgaggccgctttacaagagcacatcgcctcggtgcgcaatcatattcgcttactggggcgtaaagactaccagcagcttcccggcctccgctcgctggactatgttctgatgtttatccccgtagaacccgctttcctgctggcgttagataaacagcccgaactgataaccgaggcgctgaaaaataacattatgctggtaagccccacgacgctgctggtggcgttacggacaatcgccaacctgtggcgctatgaacaccagagccgcaatgcgcagcacatcgcagacagagccagtaagctctacgataaaatgcggttgttcgttgatgatatgtcagcgatcggtcagagtctggataaagcgcaggataactaccgccaggcgatgaaaaaacttgcgtcggggcgtggcaacgttttggcgcaggcggaggccttccgggggctaggcgtggaaatcaaacgcgagattaatccggatttagcggaacaggccgttacgcaagatgaagaatatcgtttacgatcgatccctgaagggcggcaggatgaacattatcccaatgatgaacgggtgaagcagcagttaagttaacccatacggagtagtttagtcctggcgcagagtagggcaaattggcccaatctgttacacttcttgaacatttttatcgataagcaggcactgagatggtggaagattcacaagaaacgacgcactttggctttcagaccgtcgctaaagagcagaaagctgacatggtggcccacgtttttcattctgtggcgtcaaagtacgatgtgatgaatgacttaatgtcatttggcattcatcgtttgtggaagcgcttcaccattgattgcagtggcgtgcgtcgtggacaaaccgttctcgatttagcgggtggtacgggcgatcttaccgcgaaattttcacgtatggtcggggaaactggcaaagttatcctggcggatattaatgattccatgctcaaaatggggcgtgagaagctgcgtaatatcggcgtgatcggcaacgtagagtatgtgcaggcgaatgccgaagctctgcctttccctgataatacgtttgattgcattaccatttcgtttggtttgcgcaatgtaacggaaaaagaaaaagcgctgcggtcaatgttccgtgtgttgaaacccggcggacgtttactggtgcttgaattttccaagcctatcattgagccgctgagtaaagcgtatgacgcctattctttccatattttaccgcgtattggctcgatggtcgcaaacgatgcggatagctatcggtatctcgcggaatccatccgtatgcatcccgatcaggataccttaaaagccatgatgcaggacgccggatttgagagcgtggattattacaatctgacggcgggcgttgtggcattgcaccgtggttataaattctaggagggtggaatgccttttaaacccttagtgaccgcaggaattgaaggtctcctcaatacgtttctgtatcgttcgccagcgctgaaatcagccagaacgcgcttacagggaaaagtactgtgtgtgaaactaaagggattttcgatgccattagtcctggtattcagtgaacgccaggttgatgtgctgggggcatgggaaggcgaagcggactgtacggtaatcactcaagctagcgttttgccaaaactacgcgatcgtcagcagttggccacgcttattcgcagcggcgaactggaagtgcagggcgatattcaggtcgtgcaaaattttgtggcgctcgccgatctcgccgaattcgatcctgcggagctgttggcgccatacacgggtgatattgcggcggaaagtatcggtaaggtcgtgcgtggcggggctaaattcctgcgccacgggtttcaacgccagcagcgttatgccgctgaagcgatcactgaagagtggcgtatggcgcctggcccgctggaagtcgcatggtttgccgaagaaaccgcggctgttgagcgcgccgtagattctctgaccacacggctggaaaaactggaggccaaatgacgccaggtgaagtacggcgcctatatttcatcatccgcacgtttttaagctacggccttgatgaactcatcccccgaatgcgtcttacactgccactccgattatggcgctattcgctgttctggatgccaaaccggcataaagataaattgctgggtgaacgattaagactggcgttgcaagagctgggaccggtctggatcaaatttggtcagatgctctccacgcgccgtgacctgttcccgccgcaaatcgccgatcagctcgctttgctccaggataaagtcgcgccattcgatggtcggctggcgaaagcccagattgaagaggcgatgggggggctacctgtcgaagcctggtttgacgactttgatatccagcctttagcgtcggcgtcaatcgcccaggtacataccgcgcgattgaaatcaaacggtaaagaagtggttattaaggtcattcgcccggatattttgccggtaattcaggcagacctgaaactgatttatcgccttgctcgctgggtaccacgcctgttgccggatgggcgtcgtctgcgcccgacggaagtggtgcgtgagtatgagaaaacgctgatcgatgagctgaatctgctgcgggaatcggccaacgcgattcagttacgccgcaattttgaaaatagtcccatgctgtatatcccggaggtgtactccgattactgtagccagaacatgatggtgatggagcggatatacggcattcctgtttcggatgtggcggcgctggaaaagaacggcaccaacatgaaactgctggcggaacgcggggttaaagttttcttcacccaggttttccgcgacagctttttccatgcggacatgcatccgggaaatatttttgtcagccatgaacaccctgaaaacccgcaatatatcggcattgactgcggtatcgtcgggtcgctaaacaaagaagataagcgttatctggctgaaaactttatcgcgttttttaatcgcgattaccgaaaggtggcagaactgcatgtcgattcaggctgggttccgccagataccaacgttgaagattttgagtttgccatccgcaccgtctgtgaacctatctttgaaaagccgctcgcggaaatctcgtttggtcatgtgttgttaaaccttttcaatacagcgcgtcgatttaacatggaagtccagccgcaactggtgttgttgcagaaaacattattgtatgttgaaggggttgggcggcaactttatcctcagcttgatttgtggaaaacggcgaagccgtttcttgagtcctggatcaaagatcaggtgggtattccggctctcacgcgggctcttaaagaaaaagcgccgttctgggtcgaaaaaatgccagaaatacctgaactggtgtacgacagtttgcgccagggcaaatatttacagcacagtgttgataagattgcgcgcgagttacaggtaaaccatgtgcgccaaagtcagtctcgttatttattgggaattggcgcaacgctgttactgagcgggtcattcttactcgtcaaccgccctgaatggggattgatgcctggctggctcatggtcggcggcgtagttgtctggctggttggctggcgtaaaactcgttgagattttttatcgctcaacgccggttgtgtcacgcaggtacatattatcactcgaggcaatactcaggccgcaagtcaatgtcgtcccggtcgtatgtaaaagtatgtgaatagggcgggcgaaagcggctaacaaagaggcagcgtgaaggataatgtgtataatgcggccctaataattcatcatctatcacagaggaacatgtatgggtggtatcagtatttggcagttgttgattgttgccgttatcgtcgtactgctgttcggcaccaaaaaactcggttccatcggttccgatcttggcgcgtctatcaaaggctttaaaaaggccatgagcgatgatgatgccaaacaggataaaaccagtcaggacgctgattttaccgctaaatctatcgcggataagcaaggcgaagcgaaaaaggaagacgctaaaagccaagataaagagcaggtataatccgtgtttgatatcggttttagcgaactgctgttagtgttcgttatcggcctcattgtgttggggccgcaacgattgccagtagcggtaaaaacggtagcgggctggattcgcgcgttgcggtcccttgcgacaacggttcagaatgaactgactcaggaactgaaacttcaggagttccaggacagtctgaaaaaagtcgaaaaggcgagcctggaaaatctgactcccgaactgaaagcatctatggatgaactgcgtcaggcggcggagtcgatgaaacgcacctacagcgctaacgatcccgaacaagcgagcgatgaagcgcataccatccataatccggtggtaaaagggaacgaaacgcagcatgagggcgtcacccctgccgccgctgaaacacaggcgagcgcgccggaacaaaagccggagcccgttaaagctaacgtgcctgagtcgacggaaaccgcttccgtagccacgatagacgccgagaagaaatccgctgcgcctgttgtcgaatcttccccctcgtcgagtgataaaccgtaaacatggctgtagaagatactcaaccgcttatcacgcatctgatcgagttgcgtaagcgcctgctaaactgcatcgtcgcagtacttctgatttttctggcgttaatttatttcgccaatgatatttatcatttagtcgccgcaccgctgattaaacagatgccgcaaggggcgacaatgattgcgacggatgtggcgtcgccgttttttacgcctatcaaactcaccttcatggtgtctttgatcttatccgcgcctgtcattttgtaccaggtttgggcctttatcgccccggcgctgtataagcatgagcgtcgtctggtcgtacctctgctggtatccagctcgctgcttttctatattggtatggccttcgcctattttgtcgtattccctttggcctttggtttcctgacgcatacggcgccggaaggggtacaggtttcgacagatatcgccagctatcttagctttgtcatggcgctttttatggcctttggcgtagcctttgaagtgccggtggcgattgtgttgctgtgctggatgggcatcaccacgccagaagatttgcgtaaaaaacggccttatatcctggtcggggcattcattgtgggaatgctgcttacgccgccagatgttttctcgcaaacgttgctggcgataccgatgtactgcctgtttgaaattggcgttttctgctcacgcttttatgtcggtaagcgacggacgcgcgacgaagataacgaggccgaaaccgaaaaggccgagcacactgaagactaaacacaaccgcccgccagggcggttgtcatatgggggcaagcatgtttgatattggcgttaatttaaccagtagccagtttgcaaaagatcgtgatgatgtggtcgcccgtgcgtttgcggcgggagtaaaaggtatgctactgaccggaacgaacatccatgaaagtcagcaggcgttaaaactggcgcggcgctacccccattgttggtcgacggctggcgtccatccccatgacagcagtcagtggtcacccgcgtctgaagacgccattattgcgctggcgaaccagccggaagtcgtcgctatcggtgagtgcgggctggatttcaatcgcaatttttccacgccgcaggagcaggagcgtgcctttcaggcgcagctacaaattgccgccgaattgcagataccaatctttatgcactgccgggacgcgcatgagcgatttctggtattgcttgatccctggctggatagtcttcctggtgcaatactgcactgctttaccggttcacgccagcaaatgcaggcctgtgtggatagagggctctatatcggtattaccgggtgggtttgcgacgaacgacgcgggcttgagctacgtgaactcttaccgtttattccagcggaaaagctactgatagaaaccgacgcgccgtatctgttgcctcgcgatcttacgccgaaaccaacgtcacgacgcaacgagcccgcgtatctgcctcacatcctggagcgcatagcgctatggcgtggtgaagatccgcaatggttagcggcgatgacagatgccaacgccagaaccttatttgaggttgtattctgaacgatcgctaaatcttgcgaaaaccggtgtttttcacgctctgcttcacttctttattgagtaaattaagcagtaacatcgaacgcgtttcgccatccggttcggtaaaaatcgctttcagcccttcaaatgcgccttccgtgatgatgacgctatcgccgggatagggggtttcaggatcgacaacgccttcgggcttgtagatagaaagctgatgaataacgctggaaggcacgatcgcaggatgcgcgccaaagcgcacaaaatggctgacgccgcgcgtggcgttgattgtagtggtatgtatcacttccggatcaaattcaacgaacagataattaggaaagagcggttcgctgacggaggtacgttttccgcgtaccattttttccagggtgatcatcggtgtcaggcaacttaccgcttgtctttcgaggtgttcctgagcacgctgaagttgcccgcgtttgcagtacagtaaataccaggattgcataatgactcttatccgcttgttcggggcgcaagcatagcaaaagccatgcgcgaagttaattatacacttcatcctttaagccgtatctggattagcgttggttgccagagttcacgctaatttaacaaaaatacagcatcccgatgatgaacgccgtataatgatgcgcttaccaagaggctacaatggacgccatgaaatatcacgatttacgcgacttcctgacgctacttgagcagcagggggaactaaaacgcatcacgctacctgtggatcctcatctggaaatcacggaaatcgctgaccgcacgctgcgtgccggtggaccggcgttgctgtttgaaaatcctaaaggttacgccatgccggtgctgtgcaacctttttggcacgccaaaacgcgtggcgatgggcatggggcaggatgatgtttccgccttacgggaagtgggtaaattattagcgtttcttaaagaacctgagccgccgaaaggctttcgcgatctgtttgacaagctgccgcagtttaagcaagtgctgaatatgccgacgaaacggttacgcggcgcgccttgccagcagaaaatcgcgtctggcgatgatgtcgatttaacgcgtcttcctgtcatgacctgttggccggacgacgccgcgccgctgattacctggggactgacggtaacgcgtggtccgcacaaagagcggcaaaacctgggcatttatcgtcagcagttgataggtaaaaataagctgattatgcgctggctgtctcaccgcggcggcgcgctggattttcaggagtggttagccgcgcgtccgggtgaacgtttcccggtctccgtcgcattgggcgccgatccggcgacgatacttggcgccgtgactcctgttcccgatactctgtcggagtatgcctttgcgggcctgctgcgcggcacgaaaactgaagtggttaaatgcctttctaacgatctggaagtgcctgccagcgccgagattatccttgaaggttacattgagccgggagagatggcgccggaaggaccgtatggcgatcatacgggctattataatgaagtggatagctttccggtctttaccgtcacgcatattacacagcgtgaggatgccatctatcactccacctataccgggcgtccgcccgatgagcctgcggtattaggggtggcgctcaatgaagtcttcgtgcctattctgcaaaaacagtttccggaaatcgtcgacttttatctgccgccggaagggtgttcttaccgcctggcggtagtgacgatgaaaaagcagtacgctggtcatgcgaaacgcgtcatgatgggcgtctggtcgtttttgcgccagtttatgtatacgaaatttgttatcgtttgcgatgatgacgttaacgcacgcgactggaatgatgtgatctgggcgattaccacccgtatggaccctgcacgggatacggtgctggttgaaaatacgccgattgattacctggattttgcctcgccggtctccgggctgggttcaaaaatggggctggatgccacaaacaaatggccgggcgaaacccaacgcgagtggggtcgtcctattgttaaagatcctgaagttaccgcgcgtattgatgcgatttgggatgagctggctatctttaaataactgaaagcggacatcgacatttcaggctgcggcgactcagcttgaaaaatgtcggtattgacccgacacccgacagagggagcgcatgacaaccttaagctgtaaagtgacctcggtagaagctatcaccgataccgtatatcgggttcgtttagtgccggacgcggcgttttcattccgcgctggtcagtatttgatggtcgtaatggacgagcgtgacaaacgcccgttttcgatggcttcaacgccggacgagaaagggtttattgaattacacattggcgcctccgagctcaatctgtatgcgatggcggtcatggatcggattctgaaagaccgggaaatcgtcgtcgatattccgcatggcgacgcctggctacgtgacgatgaagagcgtccgttgattctgatcgcgggcggtacgggcttttcttatgtgcgctccatcctgttgacggcgttagcgcgcaacccggcccgcgatgttaccatttactggggcggccgcgaagaaaagcacctctatgatctctctgagctggaagcactctctgttaaccatccgaatttgcgtattgaacctgttgtcgagcagccggaagaaggctggcgtggacgtacaggaacggtacttacggcggtattgcaggattatggtacgctggcggggcacgatatttatattgccggacgttttgagatggcgaaaatcgcccgcgatctgttctgtcatgagcgtaacgcgcgggaagatcgtctgtttggcgatgcgttcgcatttatttaactattttatgggacgcagtagcgtccctttttacgttagcctacctaaaagtcctcttaaatattaattaatcgtcaactataaaaccttatgatattgaatatctacaggctttgtattgcgtgtaataaattaagtaatattatgtcctgaggctatcaataaaaatagttaattatatatgcttcatttatttttataaaagaaacataaaatggaaagttagttatttatttataagatggagagtgttatgaaatttaaatatgctttaacttctctcgcattatctgttgcaattttgtcatcagtaccttctactgctttcgccatcggcggcgccagcggcgctaaagtggactatcaggtccagggaaaaattggcgaagttgttatgaacccctatgatatcgcgccgctaaccgccgttattcgtaatggcggttaccagttacgtgacgtgcatgtacggattgtacccaaagaaaatggccaggagatcgcgtataaagttaataataaataccttttaacgtatggcggtattcccgtctttggtctttacccggattatgtcaataccgttgaagttgaatatacaagtatccagggtagtaaaaccgaaaatgtaaaagaaagctataaaatgtatgcaccgcctgcctatattgaatcagcgggtacaaaagaagaacaatcagcactctttactatcgatgttaaaaaggtttccccagaatttaaagatcgcttgtatcttttgaataatacgaaagataagtctgggaatggaacgcgtactgtctggaacaaccctactgggggtgcattagaatggaacttcactacagctaacgctattatcgacacctccggtgatattcgttggtttatgaatccaagttcaatttatgatttaaagtcaatttatcgtgctggcgttatgatgggctttaaacaaaactaggatggcgcactatcgtggggctacggtcagcgttatgtgaaatacgatatcatggggcgtgaaatctttaaccgccgcctgccggataattataacgatttttcacactcaatggataacgcggccaacggtcactacttcctgcgtgtagccagctctaactataaacgccctgatgggaaaaatgttcgtaccgtgcgtgatgtgattgccgaagttgatcagaacggcgtggtagtggatgaatggcgtctgtttgatatcctcgatccttatcgtgatgtgataatgaaaaccctcgatcagggcgctgtgtgcctgaatatcgacgccagccagtccggccatacgttgagcgaagaagatctggcggcgctggactcctccgacaaattcggggatatcgtgggtagtggggctggccgcaactgggcgcatgtcaacagcgtcgactatgacagtgaagatgattccatcatcatcagctcccgccaccagagtgcgattatcaaaatcggccgcgataagaaagtgaagtggatactgggtacgcctgctggctggaaagcgccatttaatgccgcaattctgacgcctgtggatagcaaaggccaaaaaatcgcctgccaggacagtggctgcgagggtgacttcgactggacatggacgcaacatacggcctttaaaattgatagtaagagtaaaggcgatatcttatacctttccgctttcgacaatggcgatggccgcggcttagaacagcctgctatgcagagtatgaaatacagccgctccgtgatttacaaaatcgaccagaaaaacaagacagtccaacagatctggcaatacggtaaagagcgcgggaacgagtggtttagcccggtaacctctatcaccgagtaccagactgacaagaattctgtgttcgtgtattccgcaacagcaggtggtgcgtttgatttatcggtaggcgcatttaccagcttgcctaatccgtatctggaagagttcaaatggggagaaaaagagcctgcggttgaaatgcaaatacatggtgcgcgtggatatcaggctatgccatttagcctgaccaaagcgcttactgagtagagcaggccatacggtgaaaaaacccgcccctgacgggcgggaaaaacggcaactaaactgtttcccgtcataattcgcgcagcctctttgttggctgcctttgctcaccccgggcacatagttatctatgtgcccggggattcgctcagttgccgctgcgctgcaatgcgagttatttaggggatattatctttgattaaacccgctcaaacaccgtggcgatgccctgacccagaccaatacacatcgtcgccagaccaaactgcgcgtctttgcgctccatcaggttgataagcgtggtgctgatacgtgctccggagcagccgagcggatgaccaagcgcgatcgcaccgccgttgaggttgatcttctcgtctatctgctccatcaatcccagatccttaatgcatggcaggatctgtgcggcaaacgcttcgttcatctcaaacacatcgatatcgctggctgacagtcccgcttttttcaacgccagttttgacgccggaaccggcccgtaacccataattgacggatcacaacccaccactgccattgagcgaatacgggcgcgaggtttcagacccagctcacgggcacgactttcgctcattaccagcatggcggctgcgccatcggaaagcgcggatgaggtgcccgccgtgaccgtgccactaaccggatcaaatgccggacgcagcgttgatagcgcttcgaccgtggtttccgggcggatcacttcatcgtagttaaactgcttcaacacgccgtctgcatcatgaccgccagtcgggataatctccgttttgaatgcgccagactgggtggcggcccaggcgcgagcgtgagaacgcgcggcgaactggtcctgcatttcccggctaatgccgtgcaggcgggagagcatttccgccgttagccccatcatccctgccgctttggcgacgttgcgactcagacccgggtgaaaatccacgccgtggctcatcggcacgtgccccatatgctccacgccgccaaccagacaaacctgcgcatcgccggtcatgatcattcgcgctgcatcgtgtaacgcctgcatcgaggaaccacacagacggttgacggtgaccgccggtaccgaatggggaatttctgccagcagcgcggcgttacgggcaatgttgaagccttgctccagcgtttgttgtacgcagccccagtaaatatcatcgagggtcgccgctgtaagcgacggattacgcgccagcaggctacgcattaagtgggcggagagatcttctgctcgcacgttgcgaaacgcgccgcccttcgaacggcccatcggggtgcgaatagcatcgacaatgacaacctgttccattgtgactccttaagccgttttcagagaaccaaccggacgggctggttcaaccgggggataatacggttcgttatggcgcgctttattacgcagcccttccggcacctcatacagcgggccgaggtgttgatactgctgcgccatatcaagatatttcgcgctgccctgtgtatccagccagcggaatgcgccgccgtggaacggagggaagcccaggccgtagaccagcgccatatcggcttccgccgggcttgcgataatgccttcttccagacagcgaaccacttcgttaatcatcgggatcatcatacgggcgattatctcgtcgtcgctgaagtcgcgtttcggctggctgacgcttgccagcaggtcatccaccgcggcatcttcttctttcttcggcttacccttgctgtcttctttatagcgccagaagcccagaccgtttttttgcccaaaacggctggcgtcaaacaatgcgtcgatcgcgtcgcggtaatctttctgcatacgctgtgggaagcctgccgccattactgcctgcgcgtggtgggcggtatcaatacccaccacgtcgagcagataggccgggcccatcggccagccgaactgtttttccatcactttatcgactttgcggaaatccgcgccgtcgcgcagcagttgactgaaaccggcgaaataggggaacagcacgcggttaacaaagaagccggggcagtcgttgactacaatcggtgtcttgcccattttgctggcccaggcgacgactttggcaatggtttcgtctgaactcttctcgccgcgaatgatttcaaccagcggcatccggtgtaccgggttgaagaagtgcattccgcaaaagttttccggacgttccagggcgcttgccagttcgccaattgggatggtggaggtatttgaggccagcacggtttccgggcgcactttctgctcggtttccgccagtaccgcttttttgactttcggattttcgactaccgcttcgacaacaacatctacgcgatcgaaaccggcataatcgagagtcgggtggatggtcgaaatgacgcccgccagcttcagaccgtcgatcttgccgcgctccagctgtttgttcagcagcttggccgcttcggtcatgccgaggttcaacgatttatcgttgatatctttcatgatgaccggtacgcctttccaggccgactggtaagcgataccgccgcccataatgcccgcgcccagtacggctgcctgtttcggcgtctcaatatctttggtcagctttttggctttaccttttacatattgatcgttgaggaagataccgaccagcgcacgagcctcattggtatgcgccagcggaacaaagcttttattttccagattcagcgcttcttcacgaccaaaacgcgcggcggcttcaatggttttcactgcggtcatcggcgccggataatgtttacccgccgtttgtgcgaccatgcctttagcgatggtaaagctcatcgctgcttcaatcttactgagtttcaacggttccagtttcggctggcgtttagctctccagtcgagatcgccggtaatggcctggcgtaacaccgctatcgcgccttcaattagcttctcttgtttgaccacgccgtccacaaggccgattttcagcgcgtgctcagcaccgacatctttacctgccgcgataatctccagcgcgctgtctgcgcccagcatacgcggcagacgaacggagccgccgaaacccggcatgatgcccagtttagtttccggcagaccgatacggaggtctggcgtcgccagacggtaatcggtggccagcacgcattcgcacccgccgcccagcgcatagccgtttacggcggcaagggtcggtacgggtaaatcttccagacggttaaagacgctattagcgaaatgcagccattggcttaactgctcttcggggacgaggaacagtgaaagaaattcggtgatgtccgcgccgacaataaaggccgctttattagagcgcagcagcagcccttttaaatcgtgttgcttttccagcacctcaagcgcctggccgaggctggcgacggttgcggtgtcgagtttattgaccgagcctggagcatcgaacaccagttcggcgatgccatcttccagccagtcgaggtacagggtgtcgcctttataaagcatgtcagtctcctgaatccacaaagtgatctggtcgtaccagatgaagcgaagtgtgtattttgtgttaaaaaaatgcaaataaatgattaaagaaatgccgatgtgatcacgctcggcagagatcacgctctcgtggggcgatgtgctaagatgcgggaacttgaggtcaaaaaaacagaagggtaaaaaatggaatcactggccgcgctctataaaaatcatattgttaccttacaagaacggacgcgcgatgttctggcgcgctttaagctggatgcgttacttattcattctggcgagcttttcaacgtctttctcgacgatcacccttatccgtttaaggtcaatccacagtttaaagcgtgggtgccggtaactcaggttccaaattgctggctgttggtcgatggcgtcaacaaacccaaattgtggttttatctgccggtcgattactggcataacgttgaaccgctgccaacgtccttctggacagaagaagtcgaggtcgtcgccttaccgaaagcggatggcatcggcagccaactgcctgccgcgcgtggcaatatcggctatatcggcccggttcctgagcgcgcgctacaattggatatcgccgccagcaacatcaacccgaaaggtgttatcgactatctgcattactaccgcgcctataaaacggattatgaactggcctgtatgcgcgaagcgcagaaaatggcggtgagcggtcatcgggcggcggaagaggccttccgttccggcatgagcgagttcgacatcaacctggcgtacctgaccgccacgggacatcgcgataccgatgttccatacagcaacattgtggcgctgaacgaacatgccgccgtgctgcattacacgaaactggatcatcaggcaccgtctgaaatgcgcagtttcctgctggatgcgggcgcggaatacaacggctacgcggcggatctgacgcggacctggtcggcgaaaagcgataacgactacgcccacctggtgaaagatgttaacgacgaacagttggcgctgatcgctaccatgaaggcgggcgtcagctatgtggattatcatattcaattccatcagcgcatcgcgaagctgctgcgtaaacatcaaatcattaccgacatgagtgaagaggcgatggtggaaaatgatctcaccgggccgtttatgccgcacggtattggtcatccgttgggtctgcaggtacacgatgtggccgggtttatgcaggatgattccggtacgcatctcgccgcgccgtccaaatacccgtatctgcgctgcacgcgtgtgttacagccgcgaatggtgttgaccatcgaaccggggatttacttcatcgaatcgctgttagcgccatggcgcgaaggcccgttcagcaagcacttcaactggcagaaaattgaagcgctcaagcctttcggcggtattcgcattgaagataacgtggtcatccacgaaaacggcgtggaaaacatgacgcgggatttaaaactggcgtaatggacagttggttaatccctgcagcgccggtcaccgttgttgaagagatcaaaaaaagccgctttattacgctattggcgcataccgatggcgtagacgcggcgaaagcgtttgttgagtcagtcagagctgagcatcctgatgcgcgccaccattgtgtggcgtgggtggcgggtgcgccggacgactcacagcaactgggcttttcagacgacggcgaaccggcgggaacggcaggcaagccgatgcttgcgcaattgatgggcagcggcgtcggagaaattactgccgtcgtcgtgcgctactatagtggtattctgctgggtacgggcgggctggtaaaagcctatggcggcggtgtgaatcaggcattacgtcagcttgccacacaacgcaagacgccattaaccgaatatactttgcagtgtgagtacggtcagttggccggaatcgaagcattattaggacagtttgccgggaagatcgtttccagcgattatcaggcgtctgttcggctcagggtggcgcttccttttgctcatgtgaatgcattttccacaaaactggcggattttagccgtggttcattgcaattgttagcgattgaagaataatccccacctcatttttaagaataaaggaagcggcagagatgcattttcgcgccattacccgaatcgttggactactggttatcttattttcggggacaatgattctcccgggactggtagcgctaatatatcgtgatggcgcaggaagagcgttcacgcagaccttttttgtcgcgctggcgatcggttccatactgtggtggccgaaccgtagggaaaagggcgagctgaaatcccgcgaaggatttcttatcgtggtgctgttctggaccgtgctgggcagcgtgggtgcgctgccgtttattttctcggaaagcccaaacctcaccattaccgatgctttttttgaatcgttctccgggttaaccaccacgggcgccactactctggtggggctggattcattaccgcacgccattctcttttatcgtcagatgctgcaatggtttggcggtatggggatcattgtgctggcggtggcgattctccctatcctcggcgtcggggggatgcagctctatcgggcggaaatgccggggccgctcaaagataacaaaatgcgcccgcgtattgccgagacggcgaaaacgctgtggcttatctatgtcttgctaacggtagcctgcgcgctggcgctatggtttgcagggatgcccgcgtttgacgctatcggacacagcttctccactatcgctatcggcggcttctcaacgcatgacgccagcgtaggctattttgatagtcccactattaataccatcatcgctattttcctgctgatctccggttgtaactatggcctgcatttctctttattaagcgggcgtagcctgaaagtatactggcgcgatccggaattccgcatgttcatcggcgtacagttgacgctggtggtgatctgcacgctggtactgtggttccataatatctacgactcggcgctgacaacgctaaatcaggcgttcttccaggtcgtgtcgatggcgacaacggcagggtttaccacggacagcattgcgcgctggccgctgtttttgcccgtcttgctgctatgttccgcgtttattggcggttgcgccgggtcaacgggcggggggttaaaggtcatccgtattctgttgttgtttaaacaggggaaccgcgaactcaaacgtctggtgcatccgaatgccgtttacagtattaagctggggaaccgggcactgccagaacgtattctggaagccgtctggggattcttttctgcctacgcgctggtatttatcgtcagtatgctggccattatcgctacaggcgtagatgatttctcggctttcgcctcggtagtggctacgcttaataacctgggaccggggctgggggtggttgctgataacttcgccagtatgaatccggttgcgaaatggatactaatcgccaacatgctatttggtcgtttggaagtattcactttgctggtactttttaccccgactttctggcgtgaataatggagtaacacgtgaaaacattgattcttttctctacccgggacggacaaacgcgcgaaattgcctcttatctggcttctgaactcaaagatatggggatctgggccgatgtcgttaatctgcatcgcgcagaagagcctgactgggatagctatgatcgcgtagtgattggcgcgtctattcgttatggtcattaccacagcgcctttcaggagtttgttaagaaatatgccacgcggttgaacggaatgccgagcgccttttattccgttaacctggtggcgcgtaaagctgaaaaacggacgccgcagactaacagctacgcgcggaagtttttaatgagctctccgtggcgacctgactactgtgccgtcattgcaggcgcgcttcgctatccccgttatcgctggtatgaccgtctgatgatcaagcttattatgaagatgtcgggcggcgaaacggataccagtaaagaagtggtgtacaccgactgggagcaggttgcgcactttgcccgtgaaatagcccatttaaccaacaaatcgtcggcaaaataaacgcaaagaataaaaagtgcgcactcagaaaattattttaaatttcctcttgtcaggcaaaaataactccctataatgcgccaccactgacacggaacaacggcacacaggccgccgggtcagcggggttcggaccagaacctcacggagaaaagcgaaaataaacgcttgactctgaagcgggaaagcgtaatatgcacaccccgcgccgctgagaaaaagcgaagcggcactgctctttaacaatttatcagacaatctgtgtgggcactcgaagatacggattcttaacgtcctaggacgaaaaatgaataccaagtctcaagagtgaacacgtaattcattacgaagtttaattcattgagcatcaaacttttaaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacagaagaatccagagatggatttgtgccttcgggaactgtgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaaacggtctttgaagtgctcacacagattgtctgatgaaaaacgagcagtaaaacctctacaggcttgtagctcaggtggttagagcgcacccctgataagggtgaggtcggtggttcaagtccactcaggcctaccaaattttccctgaatactgcgttgtgaaataactcacatactgatgtatgcttcgttattccacgccttgtctcaggaaaaattatcggtaaagaggttctgactacacgatggggctatagctcagctgggagagcgcctgctttgcacgcaggaggtctgcggttcgatcccgcatagctccaccatctcgtgagtgtttacgaaaaaatacttcagagtgtacctgaaagggttcactgcgaagttttgctctttaaaaatctggatcaagctgaaaattgaaacacagaacaacgaaagttgttcgtgagtctctcaaattttcgcaacacgatgatgaatcgtaagaaacatcttcgggttgtgaggttaagcgactaagcgtacacggtggatgccctggcagtcagaggcgatgaaggacgtgctaatctgcgataagcgccggtaaggtgatatgaaccgttataaccggcgatttccgaatggggaaacccagtgtgattcgtcacactatcattaactgaatccataggttaatgaggcgaaccgggggaactgaaacatctaagtaccccgaggaaaagaaatcaaccgagattcccccagtagcggcgagcgaacggggaggagcccagagcctgaatcagcatgtgtgttagtggaagcgtctggaaaggcgcgcgatacagggtgacagccccgtacacaaaagcgcatgtgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacaggtttacctgtgtgactgcgtaccttttgtataatgggtcagcgacttatattctgtagcaaggttaaccgtataggggagccggagggaaaccgagtcttaattgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaattcatctccgggggtagagcactgtttcggctagggggccatcccggcttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgaacgtatcacccaagacaactttacggagttgacgattgacggagcgaagcgacgtcaaagcgttcattaaagtcgagttggcttagggatacgttcgttgggtaggggagcgttctgtaagcctgtgaaggtgtgtcgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacgggttaatattcccgtacttggtgttactgcgaaggggggacggagaaggctatgttggccgggcgacggttgtcccggtttaagcgtgtaggtgtgtgttccaggtaaatccggttcactttaacactgaggcgtgacgacgaggcactacggtgctgaagcaacaaatgccctgcttccaggaaaagcctctaagcatcaggtaacacgaaatcgtaccccaaaccgacacaggtggtcaggtagagaataccaaggcgcttgagagaactcgggtgaaggaactaggcaaaatggtgccgtaacttcgggagaaggcacgctgacacgtaggtgaagtgatttactcatggagctgaagtcagtcgaagataccagctggctgcaactgtttattaaaaacacagcactgtgcaaacacgaaagtggacgtatacggtgtgacgcctgcccggtgccggaaggttaattgatggggtcagcgtaagcgaagctcctgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgtggacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagatgttttggcggattgagaagacaacaattttcagctcagattcagagtccgaaggattttacgctgagacaaggcggcaaacgcagcgacggaaggagcatacagaagtatgtgactgacgctcgcaagagcagccaacgccgtatcagtgtaaaagacacaggacggagcacaaagaatttgcctggcggcactagcgcggtggtcccacctgaccccatgccgaactcagaagtgaaacgccgtagcgccgatggtagtgtggggtctccccatgcgagagtagggaactgccaggcatcaaataaaacgaagggccctgtcggaagacagggccttttgttttatctgtggtctgtcggtgagcactcgttgcgcagcaacggcccggagggtggcgggcaggacgcccgccataaactgccaggcattagtttagtgaagaagcccatcctgacggacgggcttttttgcgtgtgcggtaactgtaaaaccgtaggcctgataagcgcagcgccatcaggcaaccggcactgccggatggcggctccgccttatccggcctacaaggaacgtgctttctctaaccaccgcaaaatgaaggcagaaatctgcgatacatcattaagatccaaaacgggtaccgctacggcaagtggaatatcactggcaaccgcaataacatgctcatcaagaattaattcttcctcgctgtgcccacatccctgacgaaaaagtaagatcttcgcaactgcctcgtgtttaaacccttctaccagcaccatatctagctttgatgcatccatccggctcaccagccatgccagatccaactcttcttgccccggcgtttcagtcattaacgcccagcgctgctgactggcaaccagcgtctgtgccgccccggctttacgtaattcgtagctatctttacccggtttatcaacatccatatcatgatgggtatgcttaatcagccctggccgaataccgtgcgcacaaagtgctgggatcagttttttcagcagtgttgtttttcccgtgccgctccacgcggcaatggcgagtagcggtatcatggtctcttttgccattgcgcgagttcctccggcgtgttgacgttcacaaatgcctccttacaatcgctgaaatcaacggcgtgtccgcctacctggcgcataaaaatcattacccgccgctcgcctgcttgcaaataagctgtcaactggggctcaacggcacgattaatcaacgcgatcgttggatgatcgcgctctccatcatgaacccaaaccacgggtgcaccatgacgctgcgctgctaaacgatcgaccaggttgtgggggatacagggattgtcacagggacaaaacagaaaccagtcgcctgctacctgctgaaaaacggaaagcatacccgccagcggaccgggaaagtcagcaattgaatccggaatgactttcaggccgctggcctggtagatatccagatggcgattagcactaatgacgaccgtagcaagttgtggcgcgagcgcgtcggcaacgtgtcgccagagcggtttcccgcccagttcaagcagacctttatccgcacctcccatccgcctggctttaccgcctgccagcaccacgccggttattacttcatccagattcaccgatatcgcctcttttattgtgggattgaccctgctaccgtgtctgtatcaagaataaggagcacagctatgaaatgtaaacgcctgaatgaagtcattgaactcctccagccagcctggcagaaagagcctgatcttaatctgacgcaatttttgcagaaactggcgaaagagtcaggttttgacggcaaactggaagatttaactgatgatatcctgatctaccatctgaaaatgcgcgattccgccaaagacgccgccattccagggattcaaaaagactatgaagaggactttaaaacggcgcttttacgcgcccgcggcgttattaaagagtaaaaccttgtaagcggcgccaccgaaatcgccacgaaatgatatcctgaatcattcgtagtattttccggatgatgggatgaacgacaacgcttttactttccagacgctacacccggaaaccatcatggatgcgctgtttgaacaggggatcatggtggattccgggctaactccactaaacagttatgaaaaccgcgtctatcagtttcaggatgaagaccgtcgacgttttgtcgttaagttttatcgtcctgaacgctggtctgttgatcaaattcgggaagaacatcaattcgcgcttgaactggtgaaggatgaggttccggttgctgctccgctcgcgtttaatggccagacgctgttagcgcatcagggctatcattatgccattttccccagcgtaggcggtcgtcagtttgaagcagacaatatcgatcagatggaggcggtagggcgttatcttggccgattgcatcagacggggcgaaaacgtcctttcactttccggcctgacattgggcttgcggagtatctttttgaacctcgccaggtattcgaagatgccgcactgattccctccgggcaaaaagcggctttcctgaaagccactgatactctactgtctgcagttaccgaatgctggcgcaccgatttcgccacgctgcgattgcacggcgattgtcatgccggcaacattctatggcgtgatggaccgctgtttgtcgatttagatgatgcccgtaacggtccggcgatacaggatttatggatgctgctgaacggcgacaaagccgaacagcgaatgcagcttgaaaccattattgaagcttatgaagaagttagtgagttcgatacggctgaaattggtctcattgaacctttacgcgccatgcgtttagtttattatcttgcctggttgattcgtcgttggggcgatcctgcgtttccaaaaaactttccctggttaacaggggaagattactggcagcgacagacaacgacttttattgagcagactaaaattttgcacgaaccccctttacaattaacgccaatgtattaatcggagagagttgatcatgaaaaagatttggctggcgctggctggtatggttttagcttttagcgcctcggcagcacagatcagcgacggtaaacagtatatcacgctggataaaccggtcgctggcgaaccccaggtactggagtttttctccttctactgcccacattgttatcagtttgaagaagtgcttcatgtgtctgacaatgtgaagaaaaagctgccggaaggcaccaaaatgaccaagtaccacgttgagttcctggggccgttgggcaaggagctcacccaggcatgggcggtggcgatggcgttgggtgtagaagataaagtcacggtcccgctgtttgaagccgtacagaaaacccagacagtacaatctgccgcggatatccgtaaagtgttcgttgatgcgggcgtcaagggcgaagattacgatgcggcatggaacagcttcgtggtgaaatcactggttgcgcaacaggagaaagccgcggctgacctgcaactgcagggcgttccggcgatgttcgtcaatggcaaataccagattaacccacaaggcatggatacgagcagcatggatgtttttgttcagcagtatgctgatactgtgaaatatttggttgataaaaaataaaaagaacgccggtcactgaccggcgtttttataagatgttttaatctcttctatctgtatatctttcttatcccacagcgtattaagccaacgttgaaaacggcgtttgaatgttttgtcgttcacgtaatcgccgtgcagttcttcatttatgggttccagttgcacccgaacaacaatacgcgtcagcctaccgcttagcatatcgtagaaagggtgacgatcgttgtttgggtaacacaacgtaatattaagcagcttatcgaactgtgagcctaaaacattaatcgccattgcaataccggctgcttttggcggcaacaaatgttgataaggtgaatgcgtttgctgacgtttctcatgcgtaaatcgcgagccttcaacaaagttaacgatagtggtgggataccgacgaaacttttcgcaagagcgacgagttgtttcaacatctttgccgcgtcgatcggggtgtcggagcaggtagctacgggagtagcgcttcataaacggcatatctaatgcccagcacgccaggccgatgaacggcacccaggccaattgctgtttaagaaagtacttattcattgggatatgcttgcggaacagaacgcaaagcacaacgatatcggcccagctgcgatgattacaaatcagtaaataccaatttttcttgctcagcccttctaacccttctacatcccattgcaagtgcggattaaggcgtaacagcgctgcaagaccagcacaccagcaatacatcatgaaattgcagaaaatggagaccttgcgccagataccgggaacaggcaaaagaagctttaccataccggcaatgatgatcggtactgagcaaacaatagtgaccaggatggtcaatacgatactcaatgggagcgtgatagccgcgagtattctcgtcataataaattattcaaaagttagccataaacggtgcgcgaaaagggcgcaaggggctgattctatcagaaaacgatgctaatgatggcgctgagtgaaatagaaacactcgtaacaactatccacattatgataacggcatgaatcagataatcagaaaaacgtgatgttaacaactcattgaaaataatgggtaattattaagacgagaaggctatcgcgctgattttaaagtaatggtaagaatttacacacaaagttatccacaggttattttgcgagcgatcctgaagatcgacaaaacttttccgcaaatgcggcgaaaaactcaagttttcctcctgtatgtggcatcctttaaccataatctgttaaacaggcacggacattatggttcagatcccagaaaacccacttattctcgtagatggctcatcctatctctatcgcgcctatcatgcgtttccgccgttaaccaacagcgcgggagaacctacgggcgcaatgtatggtgtcctcaacatgttgcgcagcctgatcatgcagtatcagccgacgcatgctgcggtggtgtttgacgccaaaggaaaaaccttccgtgatgagctctttgaacactacaaatcgcatcgtcctccaatgccggatgatcttcgtgcgcaaatagagccgttacatgccatggttaaagccatggggttacctctgctggcggtctctggcgtagaagcggatgacgttatcggtacactggcgcgagaagcggagaaggtggggcgtccggtattaatcagcaccggcgataaagatatggcacagttggtgacgccgaatattacgctgatcaacaccatgactaacaccatcctcggcccggatgaagtcgttaataagtacggcgtgccgcctgagctgattatcgactttctggcgctgatgggggactcctcggataatattccgggcgtaccaggcgtgggtgagaagacggcgcaagccttgcttcagggattgggcggcctggatacgctgtacgccgagccggaaaaaattgccggtctcactttccgcggcgccaaaacgatggccggtaaattagcgcagaataaagacgtagcgtacctgtcttataaactcgccaccattaaaacggatgttgagctggagctgacctgcgaacagcttgaagtgcagcagccgattgcggatgaactgctgggcctgtttaaaaaatatgagtttaagcgctggacggcggacgttgagtcaggcaagtggctacaggcaaagggcgcgaaaccggcggccaaaccgcaggaaacggtcgttattgatgaatcgcccagcgaaccggcagcggcgctctcttatgaaaattatgtcacgattctggacgacgttacgctggaaagctggattgaaaagctgaaaaaagcgccagtttttgctttcgacacggagaccgacagcctggataatatcgccgccaacctggtgggcctctcgtttgccatcgaacctggcgttgccgcgtatgtacctgtcgcgcatgattatctggacgctccggatcaaatctcccgccagcgtgctctggaactgctgaagccgctgctggaagatgaaaaagtgcgcaaagtggggcaaaacctcaagtacgatcgcggcgtcttgcaaaattacggtattgagctgcgcggtatcgccttcgataccatgcttgagtcttacattctgaacagcgtcgccggacgccatgatatggacagtttgtccgatcgttggctgaagcacaaaactatcacctttgaagacattgccggtaaaggtaaaaaccagctcacctttaaccagatcgcactggaggaagcggggcgctatgcggcagaagatgcggatgtcacgttacagttgcatctcaaaatgtggcctgagctccagcagcacaaaggcccgctgaatgttttcgaaaacatcgaaatgccgttggtgcctgtactgtcacgcgttgagcgcaatggcgtaaaaatcgatcctgccgtcctgcacaaacattcggaagaaatcacgctacgtctggcggaactggaaaagaaagcgcatgacattgcgggcgaggcgttcaacctgtcctcgacgaagcagttgcagaccatcctgtttgaaaagcagggtattaagccgctgaagaaaacgcctggcggcgcgccgtcaacgtcggaagaggtgctggaagagctggcgctggactatccgctgccgaaagtgattctggagtatcgtggtctggcgaagctaaaatccacctataccgataagctgccgctgatgattaacccgaaaaccgggcgcgtccatacgtcctatcatcaggcggtaacggcgacgggacgtttatcgtccaccgatccgaacctgcaaaatattccggtgcgcaatgaagaaggccgccgcattcgtcaggcatttattgcgcctgaggattatctcatcgtgtctgcggactattcacagattgagctgcgtattatggcgcatctttcccgtgataaaggactgctcacggcgttcgccgaagggaaggatattcaccgcgcaacggcggcggaagtctttggcttgccgctggatagcgtgaccggggaacagcgccgaagtgcgaaagccattaactttggcctgatttacgggatgagcgccttcggtctttctcgccagcttaatattccgcgtaaagaggcgcagaagtatatggatctctacttcgaacgctatcctggcgtgctggaatatatggagcgcacccgcgctcaggcaaaagaacaaggctatgtggaaactctggaggggcgccgcctttacctgccggatattaaatccagcaacgcggcgcggcgcgcgggggcggaacgcgcggcgatcaatgctcccatgcaaggaacggctgccgatatcatcaagcgcgccatgattgccgtcgatgcctggctacaggccgagcagccacgcgtgcggatgattatgcaggtacacgatgaattagtgttcgaggtgcataaagacgacttagatgcggtagcaaaacgtatccatcagttgatggaaaactgcacgcgtattgatgtgccgttgctggtggaagtcggtagcggggaaaattgggatcaagcgcactaagcatttaaggaataacgcgcttttttcgtaattaagcaacataagcacgggggttttgtgatgggtattagaattccctatgtaaagaatgaaaaaaaattacgaaaaggtctttctgtgttgctcaaaaaagagtaaagttattcacgtagggtacagaggtaagatgttctatctttcagaccttttacttcacgtaatcggatttggctgaatattttagccgccccagtcagtttatgactggggcgttttttattgtgcgcaagaaaagtttcgctcacaccgtaggccggataagacgcgcagcggcgccatccggcatagcgggtgattattccccgtcctgaatctcttcgaccggtgccagttcactaaaccagctatccagcttctgacgtaacttatccacgccctgctttttcagcgaggaaaacgcttctacctgcacatcgccattaaaagccagcacggcttcacgtaccatattcaactgcgccttgcgcgcgccgctggccagtttgtccgctttggtcagcagaaccagaacctggatattgctctctacagcccactggatcatctgttggtcgaggtctttcaacggatggcggatatccattaaaacgactaagccctgtaggctttgacgtttctccagatattcccccagcgcgcgttgccacttgcgtttcatctcttccgggacttccgcgtagccatagcccggcaggtcgaccaaccgtttgccatctacgacttcaaacaggttaatcaattgggtacggcccggcgttttagaggtgcgcgccaggcttttttggttggtcaacgtgttcagggcgctggatttgcctgcattggaacggccagcaaaagccacttcaattccgcaatcggaaggtaaatggcgaatatcaggcgcactcatcacaaaatgcgtctgttgataattcaggttagtcaaagcggtcgtctccgtcagtcaaagcattgtggcgattatacctgaacgccagcaaaagacggatttttcggcgcatcggtgctgtaagtaaaagccatacgctttgtgagacattgaccattgcacttatgcgacatgacagagtcgttgtcaggctcaaagccagttaatatagttaaatcatgaatttatagaaaggtaattgtctgaaaaaaagggatttgccgtgtcggtatcttgtgagtttaccccaaaagagtaaagtaatgcacatagcgaggacgctaacaggatcaacgactcaggatgagggtcaggagcgccaggaggcgaagacacaggattgtcaggaagacaaacgtccggagacgttagtaaaaggaaatggaaacaacatggaatgttccaggctaagggaaaaacagggcgtgttgatagccaacagggatggtggaacccgttaagggtcgtgagtcaagaaaaaaggcggcagattactctgtcgccttttttctttgcttgctttctgctagattccgcctcaattctatactgaataaaacggcttaaagatctgacatcatgaaaaaaccaacctctgcaccgcgcagtaaagcctttggcaaacagcgtcgtaaaacgcgtgaagagttaaaccaggaggcgcgcgaccgtaaacgcctgaaaaaacatcgcggtcatgcgccgggaagtcgcgcggcgggcggcaattccgcttcgggcggcggcaatcagaatcaacaaaaagatccacgtattggcagtaaaacacctgttccattgggcgtgactgaaaaagtgacccaacagcataaaccgaaaagtgagaaacctatgctttcaccgcaggcggagttggatttactggaaacggatgagcgcctggatgcgctgttagaacgtctggaagcgggcgaaaccctgagtgcggaagatcaagcctgggtagatgccaaactggatcgtattgatgaactgatgcagaagcttggtctgtcttacgatgacgacgaagaagacgacgaagaggacgagaagcaggaagatatgatgcgcctgctaagaggcggcaactaacgggtttacaccgtgggcttgcccgtcctgcttataacccttccggttatatgttatctggtgtggttattcgttaaactacagcgattgtcgcggcgacagaaatggctgcgcagccggcttgccgcccgtcatggcgtgaagccggtacgccgtacccgccagagacgccatcggaaggagtgagcatgtctgaacagcaaatagactgggatctggccctgatccagaaatataactattccgggccacgatatacctcgtacccaaccgcgctggagttttctgaagacttcgaggacgccgcattcttgcaggctgtggcgcgttatcctgaacgtccgctctcgctgtatgtgcatatcccgttttgtcacaagttgtgttatttctgcggctgcaacaagattgtcacccgccaacagcataaagctgaccagtatcttgacgcgcttgagcaggaaattcgtcatcgcgcgccgctgtttgcagaccgtcatgtcagccagcttcactggggcggcggtacgcctacttacctgaataaagcgcaaatcagccgcttaatgacgctgttgcgtgaaaatttccactttaataccgacgcggaaatctcgatcgaagtcgatccccgtgaaattgagctggatgtgctcgatcatttacgtgcggaaggttttaaccgcctgagtatgggcgtgcaggactttaataaagaggtgcagcgcctggttaaccgcgagcaggatgaagaattcatctttgcgctgcttaatcacgcccgcgatatcggctttacctcgaccaatatcgatttgatctacggtctaccgaaacagacgccagaaagcttcgctttcacgctgaagcgtgtgacggaactgaaccccgatcgtttgagcgtctttaactatgcgcatctgccaacgctttttgccgcccagcgtaaaattaaagatgctgatttacccagcgcgcagcagaaactggatattttgcaggagacgatcgtatcgcttacccaggctggttatcagtttatcgggatggaccattttgcccgtccggacgacgaactggccgtcgcgcagcgcgaaggcgtgttgcaccgtaattttcagggctatacgacccagggcgataccgatctgctggggatgggggtttctgctatcagcatgattggcgatggctacatgcagaaccagaaagagctgaagcgttattaccagcaagtggatgagcggggcaatgcgctatggcgtggtattacgctgacccgtgatgattgcattcgtcgcgatgttatcaaggcgctgatttgtaacttccgcctggattttaacgctgtcgaacagcagtggggtttgcatttcgctgagtattttgccgaagatttgcagttactgtcgccgctggcgaaagatgggctggtggatattagcgagaagggaattcaggtgacggcgaaaggtcgtttgctgatccgcaatatctgcatgtgctttgacgcgtatctgcgccagaaagcgcggatgcagcagttctcgcgcgtcatttagccgggttgcccggtggcgctgcgcttaccaggcctacacgttgcgacaacctgtaggccggataagcattagcgccatccggcacattgtcagctgaacagtcccaccagcgcggcacacaacacggcggctagcgcagtttgtggcgtgtggctgtcgaccgctccactcgataccagattaataatagattctaacataatgaatccccccgtttgccgggcatgatcatactgaactcatcggaacagtaaagcgcaaaatagcagcgttttgcgctcaattattaatctttacactcgcgggtaatgtttactccattcccagctctttcaacttccgcgttagggtgtttcgcccccaaccgagcagcctggcggcttcctgtttatgaccctgcgtatggcgtaatgccgtggtcagtagcgttctctccagttctggctgcgcttcagaaagcaggttttgatgaccggatcgcaaggcgcggtccgcccattgtgccagtaatgtagcccagctatccggcggcaggtgggacgggctatccggcgtcgaggcttcaaacagttcgcccggtaaatcctggatcaatacctcctgtccggcggccatgacggtgagccagcggcaggtattttctaactgacgcacgttaccaggccatgccaggcgcgttaacgccgtttcggtttccggatgtaataatttggcttccacgcctaattcacgggcggcgacctgcaaaaaatggcgcgccaggcgcggaatatcctcacggcgttcacgcaacggcggaagatggatacgaatcacgttcaggcggtggaacaggtcttcgcggaatttcccttcctgaacgcgtcgttcgaggttctggtgggtggcggcgataatgcgcacatcgacttttaccggcgcgtacccgcccacgcggtagaactgtccgtcagccagcacgcgtaacagacgagtctggacatccagcggcatatcgccaatttcgtccagaaacagcgtgccgccgtcagcctgctcgaaacggccctgccggatggtattcgccccggtaaaagcgcctttctcatggccaaacagttcggattcaatcaaatctttcgggatggccgccatattgagtgcgataaacggcgctttggcgcgtgggctatggcggtgaagcgcatgggcgaccagttctttaccggtccctgattcgccgttaatcagcacgctaatcgaagaacgcgacagccgaccaataatgcgaaacacatcctgcatggcgggcgcttcgcctatcatgtctgttgtcgggccgttaacctcgatattacgcggctgttgctgctcctgatagtggctaatcgcgcgctcgaccagagcgacggcttcatcaatatcaaacggtttaggcagataatcaaacgccccctgctgataggcgctcacggcggcatctaaatcggaatgcgcggtcataatgatgaccggaagcatcgggtgacgctgtttaatctgctttaatagcgccagcccgtccattcccggcattcggatatccgacagcaagacgtccggcgttttactggccagcgcagccagtacttcattaccattctcaaaggtggtacaggtcaaccctgccccggcgagagcacgctcaagcacccaacggatggaactatcatcatcgacgacccagactattcctcgttgcataaacacctctatttccgaatcggcaggtaaaccgaaaactcggtatgccccggccaactggtaaattcaattttgccggcgtgttgatcgataagattgcgggcgatagataacccaagcccggtgccgccttcgcgaccgctgaccatcgggtagaacagcgtatcctgtaaatggggaggaatgcccggcccattgtcttcaacgtctatacgcgccgccaggcgatagcgttcgccatgcagcgttaactggaaggcggtacgggtacgcagcgtaatttcgccgccttccggccccagcgcctgcaaggcattgcggacaatattcagcagtacttgctcaatttgttccgggtcgtgcggcagttctggcaaactggggtcataatcgcggataagccggacattatccggcagttccatcgacaccagcgccaccacgcgctccgcgactttatgtatgctctcggtaatgtgcattcccgggtgctgcggccccagcaaacgatcgacaaggttgcgtagcctgtcggcctgttcaatgatgactttggtatattccgttagcgccgggtcgggcagcgccttgctgagtagctgcgccgcgccgcgcaggccgccgagcggatttttgatttcgtgcgccagaccgcgcaccagatcgcgggcggcgatttgctgcgcgtgctgcaactgctcctgactcagacgacgctggttatccatcggcgccatttcgagcagtataaaatcgtcgggcagacgttgggcggtcaaagagagaatatgcgagcgactatcaatcaccagcgtcacttcgttatcggtaaagccttgccctgccgctaaactttcgcgcatcaggtcaatgtttaacgaaaaatagctcaacagttcaggtaacggcgtcccgaacagtttgcgtgagctttgcgcgagcaactgctgcgcggcaggattggcgtaatggattgccagcgcgtcgtcgaccaccagcacgctgttgattaacgaattgaggatctgcccagcatcgggctgtatgccgcttgccattcagcagtctcctggaaaaggttgcaccattttagtgcattatagctttttaccactaaaaagcgcgtgagatcagattgttggtggagaaaaaagcccatcctgggatgggctgaaagtttccacggcaactcaaaaactcctgacgcctttcacgctgctgctgcgttggctgccttcgcttaccccagtcacatcgctatctatgctcctggggatgtgctcagttgctgccttgcagcaacgcgaaatttgtcggatttttaatatacgattaaacgctgtagtacagctcaaactctaccgggtgcggggtcatacgcacgcggtcatcttcttcgcgacgcagcgcaatatacgcatcgatcgcttcatcagtgaacacgccgcctgctttcaggaactcgcggtccaggtccagcgcgttcagcgcttcttccagagaacccgctacctgtgggatctctttcgcttcttccggcggcaggtcatacaggtttttgtccatggcttcgcccgggtgaatcttattcttaatcccgtccagaccggccatcagcagggcggcaaagcacagatacgggttagccgccgggtccgggaagcgaacttcgatacggcgcgctttcggagacgccaccaccggaatacggatggaggcggaacggttacgggcggagtaggccagcatcaccggcgcttcgtaacccgggaccagacgcttgtaggagttggtggtcgggttcgccagggcgttgatggctttggcgtgtttgatgacgccgccgatgtagtacagcgcttgttcagacaggccggcatatttgtcgccagagaacaggttggtgccgttcttcgccagagacatgtggcagtgcataccggaaccgttatcgccgaacatcggttttggcataaaggtcgcggtcttaccgaagcggtgagccacgttatgcacgacatatttgtaaatctgaatttcgtcggcttttttggtcatggtgttaaagcgggtcgccacttcgttctgacctgcggtcgctacttcgtggtggtgcgcttcaacgaccaggcccatctgctccatgaccagacacatttcagaacggatatcctgcgcggagtcaactggcggaaccgggaaataaccgcctttcacgcccggacgatggcctttgttgccgccttcgtacttggtagaggagttccaggcgccttcaatatcgtcaatcgccacatgtgagccggagatagatgcgccgaagcggatgtcgtcgaacaggaagaattcaggttccggcccaaacaggacggtatcggcgataccggtcgcgcgcaggtagtcttccgcacgttttgcgatggaacgtgggtcacggtcataaccttgcagagtgccaggctccaggatgtcacaacggataatcagggtggagtccgcgaagaacgggtcgataaccgcagtggacgcatcgggcatcagcaccatgtcggattcgttaatgcctttccagccgccgatagaggagccgtcaaacattttgccttcttcaaagaattcggcatttacctgatgagcaggaatcgtgacgtgctgttctttgcctttggtatcggtgaagcgcagatcgacaaacttcacttcgtgctcgttcagcatcgtcaaaacgtgttcagcggacatacttgtactctcccggattggtcatggtcggtcgtcgtggtaacgagatcttcaattctgctggccgtgtcgccgtaaaaatataaagcgaaatctgtgccaactttcacattgcccccaaaaggcgttatcatgcgcaccatcgtgcaaaagggctgcaccacggtgactatgttgcaccaaaatagtgctttaatgtgaacattaagcaccacattggtgcaacagaacgcaagccacccttttaacgctccgtgaaagcgatcacaaagagactctgcaatacttgtttgcggaggatgtttgtgatcctgttttgtagtgcgattaatccgtgtacaataacgcgctatttctaatgcctgaggcaaagttgtgatcgaaaatttgcgtaacatcgccatcatcgcgcacgttgaccatggtaaaactaccctggttgataagctgctccagcaatccggtacgttcgacgcgcgtgccgaaactcaagagcgagtgatggactccaacgatttggagaaagagcgtggtattactatcctcgctaaaaacaccgctattaaatggaatgattaccgtatcaacatcgttgatactcccgggcacgctgacttcggtggtgaagtagagcgcgtcatgtccatggttgactctgtgctgctggtggttgacgcatttgacggcccgatgccgcaaacgcgcttcgtgaccaaaaaagcctttgctcatggcctgaaacccattgtggttatcaacaaagttgaccgtcctggcgcgcgccctgactgggttgttgaccaggtattcgacctgtttgttaacctcgacgcgaccgacgaacagctggacttcccgatcatctacgcttcggcgctgaacggtatcgcgggtctggaccacgaagatatggcggaagacatgaccccgctatatcaggcgattgttgatcatgttccggcgccggacgttgacctcgatggtccgttgcagatgcagatctcccagctggactacaacaactatgttggcgttatcggcattggccgtatcaaacgcggcaaagtgaagccgaaccagcaggtcactatcatcgatagtgaagggaaaacccgtaacgcgaaagtaggtaaagtgctgacgcatctgggtctggagcgtatcgacagcaatatcgccgaagcgggcgatatcattgcgatcaccggtctgggcgagctgaacatttccgacaccatctgcgacccgcagaacgttgaagcgctgccggcgctgtccgttgatgagccgaccgtgtctatgttcttctgcgttaacacctcgccgttctgcggtaaagaaggtaagtttgtgacttctcgtcagattcttgaccgtctgaacaaagagctggtgcataacgtggcgctgcgcgttgaagaaaccgaagatgcggatgcgttccgtgtatccggtcgtggcgaactgcacctgtccgtgctgattgaaaatatgcgtcgtgaaggtttcgaactggcggtttcccgtccgaaagttatcttccgtgaaatcgacggtcgtaaacaagagccgtacgaaaacgtgacgctggacgtcgaagagcagcaccaggggtctgtcatgcaggcgctgggcgagcgtaaaggcgacctgaaaaacatgaatccggacggtaaaggccgcgtacgtctcgactacgtgatcccaagccgtgggctgattggtttccgttcagaattcatgaccatgacttccggtacgggtctgctgtactccaccttcagccattacgacgatattcgtccgggtgaagtgggccagcgtcagaacggcgtactgatctccaacggtcagggtaaagcggtggcgtttgcgctgttcggtttgcaggatcgcggtaagctgttcctgggtcacggcgcggaagtttatgaaggccagattattggtattcacagtcgctccaacgacctgacggtaaactgcctgaccggtaagaaactgaccaacatgcgtgcgtccggtacggatgaagcggtgattctggttccgccaattaaaatgagccttgagcaagcgctggagttcattgatgacgacgaactggtagaagtcaccccaacctctatccgtatccgtaaacgtcacctgacggaaaacgatcgccgccgtgcgaaccgtggtcagaaagaagagtaattaacgctcttacggataaaaaccctgccgaaatgaaagctcggcggggtttttttattcacgttgagaaagggataaggttgccaaaaaatcagcaatcgctggcgtattatgccgaccaatgacgctatccgcatacacctttgcccgagcgctggcattccccatcgcgacgcccaatccggctaaacgtagcatttccgcatcgttatcattatcgccaaacgccatcacttcgcgcattgcgatatgctgttgctgtgcatatctggcgaggctttgtcctttgctacaccccttctggagaatatccagttgatgatgccaggaccaggtacagcttagatgtaattcatgctgtataaactcagcaatattttgtagttgttttatgtgccgatgaacgatgctgatttgccagatattctccctactgcttagctcatcagcctgaaagattattttatcatcagcacgaattgtcggtttaagcggatatacccgcgccagtattttttccgtttgtaagtgcgtcagcggcagcgggtgaaggatctgctgttgagccggttgataaatatagcttccgttacaacagatcatcggttcggtgagcgccagcgtttgataatacgcataggcttcacgatgagagcggccggtgacaagcattattcggcagcccatgtcctgcatctgacggatggcggttagcgactctggcagaatttgtttattacggtttagcagcgttccatcaagatcaaaagcgattaaacgatatcgcatgagcgtccgatcctaaaacagcgtgaggcatccaggtgattcagcaatggaatatcgagacggtgctgataagcgagaaaacagtggcattgctttgcctggcaggcgggagaattgagccgttgttgatataaattacccattttaattttgctgatatgacaagcaaaaagatcgccttctgcattcataaaaatactttttcttcctgcggtacagatatccagctgcgctggccactgctgcgtttcaatcacatacagcggatcgagttcgccgaaggcgatggtttcctcaacggtatgccgggtattggcacactcgttggcgttaaaccaaaaataattctggtcaggcaactgctggcggagccaacgaaactggtcgatatctttcatactggcgacagcccccgcgcaccaggttattccggcggcagagagcgctaaacactgctggagaaagcgctcagcggtaatttgtgagggatgaaaagaacaccataaccgaagctttgagatatctccgccgccagcacgaaatgattccagcaatgacattaacgaaaaagaggcgttagtttgtatgccgaccgcctgaacatgaggatagcggctaatttctgccagcgccgccatgtaataacgcaagcgtagcgcctcgccataaggcgtaatcatcacattcaacggcgtacctaaaagaggcaaatggtcaaccatgcgccatagcgcggcttcgtcgcgttttttatcgttacgggcgtgtttatggaacgggcaatagccgcaatgataattacacgatttaagatagccgcgataaaacagcgtgtgaatatcgcgcagggcgggggcgctcatctctgccgattctcccgtagcatcacctcaggcgaaacgaacacaggagcaaggcaatcggataatgccataccggtctccgttagccggaggcgactgccattctgatagcagtaaccctgccgtatgaagcgttcaaggtcggggaaatcccttagcgcatcgctggcaaaatattgctgataatcgctaagagaaagtccctgccagaaaaatagatttttaatgataaagcggcgtttcatttcatcagggggaagcagataaccgtgattaatgacggttttatccgggctgtcgataaacgcctgaatgatttttcgtgatgtttgcaggttcgacgaccacggtgaacagtaatgcagattgccaagataacttctgccgcccgcgccgagcgccagtgagttttcaaatccgcagctttccgccgcggcggatggcgctggattaaggacgaaacggcgcatggacgtttgggtgtagcccgcgttgcgtaaaagatcgcgggctaaaacgtagtagctatgcatattttcctggcgaggcatattataaagcggataaagaaacagctcttccggttgataaacgagcgcctgatgtaatgattccgtcaggcttgcgtgagtctgtccgggaatgccataaataatatcaatattgagtgatggaaaatgacccgcctttagccattccagcgcctggtgcgcgctggcggcattgtggcggcggtgcagcgtatgtaactcgctatcatgaaaactttgtacgccaatactgacgcgattaacggaaaaggcgtttaatagcgctactttttctgctgtggtatccgtaggggaagtttcaatcgttttataaatattccagtcaacattgagcacatcaaagacggaaaaaaataacttctctaattgcgcaatatttaatagcagaggtgtgccgccgcctacggtaaagcttgcccagtgggcgggcgccagcgccatttgtcggccctgggtaataatcgcgtcgatatagctatcaatgaacgtattatctgcgccagtgcaggtaaataaattacagaacccgcagcgactttgacaaaagggcatatgaacatacagatgtgtgtcgtgctcgtaaatgcgcggttttacttcgctaaagctgacgttctccagctcccgataagccgtcttatgcggataactgtacatatactgacgataaatatcattgttattcatattaatgattacagctcagcaagaaatgcatatagggaacggtattaacgatcggatgattaaaactatggaaatatttcccgtcttcgccatagcaggtaccgtgatcggaacagacaataacgaacgtttcgccgccagtttggcggaaaatgttcagtaatccgtcgatgcgggcgtcgatatagcgtagcgcggcggcatgggtctcaacggtatcgccaggggccgcgccctcaacgtaaaaatggttagggtaatgaatcgtgtcgatattgatatacatcatgaccggttggctgccagcacgctcggccatgattttctggatataatggatctggttatccatactctctttaaccgtacaggcaaagcgtggatgccagtaactctctttaaacatcgacgggaacacttttcccatgccggagcggttattaaagaaagagacgccgccaatacagatggtctggtagcctttattttccagactttttatccatgttgcgtcatcaaaggcaaatgcatttttcgggcctttacgaccaagtccgatatcttttgggaaaaacagcatggtctgattaacggtatcatcaataggttttggcataaaacctgaaaacatggcgtgatgcgaaggccaggtaaaattaccggccgcttcgcatttcgtccattgtccataatgattaaggttgggcgtatttccggcggtttgttcctgaagcgcaatgtcgtagcgtaacgagtccagcacaataaaaagaatatgagcgttattactaattagcgcattcatatcgaattcgccatcgcctgtgtcaatcgacgcgtgcagcgagacggggacttcatccattgaattatacattttgcttcctcatggcccggatttgcgcctgataaattagattattctgctgcgcatcctgataaatcaaatcaccctggccattaatttcaataatatacggcgtcaggctggtggtaagtaaaacatcaatacccgctaagcgaatgccagggaaaagtcgcatggcattttgacagagcgtatcgatctcagtcacttttgcggcagataactccagactttcgaagcagtaagcctggttttgcagatgtaagttagtaatgggctgcgaggaggttctgaccactcgccagataatttcgccatccaggcagacgatgcgtaaatcataggttttatgctttacgctggctttgggcagccactgttcgacgaggttttcctgctgaagaacgccattaataatgagctggatatcttctttctgacgatactgttggatttttttgctgttaaatagctgttgtcctgatatgacaatcgcgctgtaaagcacctgctttatgccatcagggtggcggcgcaaagcgataacgcccgccgcgccagaacccagcgagggcttaatgaacacgctggcgacccttttttcctccatgatggcggtgagctgtgcaaaactttttacgtcttccgctaccaacggcggcgtggggatgccgtgttccagtaagcgccgcttgcagcgttttttatccaacaggtgaatgaggcccgccggatggttaagccaggtgacgccaggacgcgccgccatgttctgcaaaaaatggatatagtccagaccgatcgcgtttattttgcggatgtctgtttcactgtgtactggcgggtcgattttaacgatgccagaggtcagcgaagcgtccagcgcttgcggatgagtcagcgccgtgacgggttccccaagtacggcggcagcctgcataaaataatgcgtgcgcttgctctgatgggggccaatgagcgtaatcacaataaatccctttatcgttgagtaggggaatgtgcacattcccctactcaatcactcggtgtacatcgcattcatataaatatcgccatcgtaatcatcaggctccagagcttctgaaagattcaggtttatcggcagtgtggcttttagcttttcctgcatctccggcgtcaaatagtggtggtggagatcgagtgtttccagatgcgcaattcggtctttatgctccagcagcgcctctgcgccgttgtccgttaaggtaccgcatgagagttccagcacgttaagctgcggcaggatattactttccagcacccggcgggcgatatcatcctgctcttcgctgttcatcaaccccagatgggtgagctgagggaaaagatctttcgatgccagcgccatcacgtcatccagcgaaccgtcaaaaccgtatccctctacgcccaggaagagcttcagcgtttttaatgcagggagctgcgcattttgtagttcggcaagtacgttagaagggatgccgccggaaatgatttccaggtgctccagtttctcatgatgtatagcgcccagtcgcagatccgacgcgcctttaataatcagttctttcagattgggtaacgccgcatagagcctggaatagtcaccttgtttaatccaggagatctcgcagtcttcgctctccatatcaccgataaacagtgattccaggtgagtaaagcgggaggcgttctccacaatcatatcaataataggctggcaggtttcgtcttcccaacaatcaccccagttaccaatggtcagtgagcgaagctttggcagatcttcatcggttaaaatcaaattaatgagctgttcctgggttaattcattgtcccaatcaatattaaatcgcttattcatttgtttcccttctctataagcatgaatatggtaaaacgctttgcgaatattatcatggcgcttaggggcgggatatcgggagtctgattcaggatgaatgagcgggcagaacaactacccgctgtgatgctgattcgtaaaatagaggcaataatatcagaagaaatacttcgccccgatacgaatctggttttgctctctatggtaggggcccacgttacgatctaaccagcgtaattcaaagtagggcaaccagtgttcattgatacgataacggaaggtattagtgatttcccaatgatgcttcgtaccattactactattaaaatcattaacgttataaaaatagtgtggttcaaaggtataagaaaatttatcggtaatgataaaattccaatagttaccgatttcatagctgtcattattatccagttcgccattcaaatcggttgaactataattattgtgattatatcggttacgtaccgtaagattaaaccacggggtaaatttatagttaacatccagatagacggcgccgccggaaccaatgcttttgtcgtttattaaccccccaggctggatggttaatttatctgtaggtttaaataatggataccagccctcaatctcattataaccgtgctttaattcatcatcacgctgtagcgtataggtattggtcaacataattccggcccccatatcggagttatagccgacgcgcagcataaactccatttggtcagacgccaggttataggcctcacggttttctacataagcgccagcaaaaacagaggtggatattactgaagttaatatcactagagtattcagagatttcataataaatccatttttcaaatatagggaagccgccatccatcgggatggataaagcggcaagcgtcgtttaattatttacagtagaaatactttgtttattattagtcgcgacaatttgattacctgttttctttcgttgggcaatttcctcgataataaaagcgaaacgttgttcattgagcttataaaaaaagcccatcgttagtgctgcgataatggcaagaccgcaaggccataaaaaaatgagctgacgcaaaccaagcaacgtggtgtcactttgagctatgttggggatataaccgatttgcgtcagcataatacctggcaaaaagccagcaagcgcagcggaaattttgcgggaaaaggtataacccgtatacaccgagccttcagcgcgaatacccgttttccattcaccgtagtcaaccgtatccggaaccagcgcccagttcaggctgttgacgaaagcggtaccgaagaaggcgatacaagagaaaataacaaacaggaatgacgttccaccccagataaaattcaggatatcgccaacggcccacaatatcagaccaccaagataaacctgttttttcccgaagcgttttaccgcagcaggtactaataaaacaccaatcaggatacagcccatgctgaaaaaacccatccatgacaacaaatgaatatcgttcagcacgtactgagtgtaataaacctgaatggccagcttgatattaaaggcggccagcgtgcacaaattggcaacgcagagcaccagcagcggcggattacgaaaaatcgcgcagaaggacttcaatatgctgggtttatgcgtgtcaggtacggtttcgatataccgttcttttaccccgctaaagcaccaccacatgctgaacagcccgcagaccgaaaagatgactgctgcaatcagataacccagcgaaggggaacgggtaaacagcgcctgaatgggcataaaacctacggtacaaagaagaaggccaatggtagcgccgccttgtcgccatgcggcgagctgggcgcgctcatgcggatttttggtaatagcgggtaccatcgcgccgtatgagcagttcatcaggctgtagaacagaccgaacaacataaacagcaccgtcgcgaaggctgttttaacgggtaaagtaaagtgagtggcaaagaattgcgcagtagcaaccagagcgactggaaatgacgcatacagaataaaaggccgaaactttccttttgcgccaatattacggcgtgagtccagcaatacgccggtgagcatatcggtaaaagcggtgaagaatttcgccaccagaaagataattccaccgtaatatgcaggcatcccgagttcatcggtataaaacttcagtagatacagcgtaccgatacacagcatcagatttgagccgaaatcgcccacgccataggcgcatttttcccgcaggctcaactttagcgttagcggatcatgattagacataatcgcctctcaaaacgccccgcagggcgttatattttattgttgttaaaccgtatgtttccgggcctcaatctcttccacaattcgcacgtacatcttctcgttgaggttgtagaaacagcccatcgcaataatggtgatgaccgccagcacgcaaggataaataaagatcaactggcgtaggccttcgacggtgcctgccgattgcaccacattcgggatataaccgatttgcgttagcatccagccggggaagaaccctgccagcgcctgggagaccttacggaagaacgtgaagccggtgtaaaccgtcccttccgagcggacgccggtgcgccattcaccgtactccaccgtgtcggaaaccagcgcccagttcaggctgttgacgaaggcggaaccgaagaacgccaggcaggagaaggcgacaaaactgaccgagccgccgccaaagaagtagttgagcagatcgcctgccacccatattaacagcccgccgatatagactttcttcttgccaaaacgccttacagcgccgggcatcaaaaaaacgccgataaaaatacagcccatgctaaagaagcccatccaggagaggaggatcgggtcgttaagaacgtactgggtgtaataaacctgaatcgccagtttgacgttgaaggcgccaagagtacaaaggttggcgatacacagaataaacagcggacggttaccggcgatggcgcggaacgactgcaataatccaggcttttgcgcgctatcgacaggtttcacttcgacgtagcgctctttaacgccggcgtagcacagccacataaatagcaggccaaacaatgaaaatagcgtggcggcgaaaatatagctgagttgggcattgccttcgatcaggttcatgaccggcacaaagccaacggtacacagcagcaggccgagagtggcgccgccctgacgccaggcggcaagcgaggcgcgttcatccgggttcttggtaatcgcgggtaccatcgcgccatacgagcagttcatcatgctgaaaaccagcccgtacagcataaacagcatcgttgcgacgacggtttttcccgtcacctcaaacggtgtgccgacaaagttagcaatcgccagtagcgttaccggaaatgccgcgtaaagcacgaacgggcggaatttgcccttcggaccaattttacgccgcgagtcgagcataatgccggtacccatatcggtaaatgcggtaaaaaatttggcgatcaggaaaatgatcccgccgtaagtccctggtaaacccagcacatcggtataaaatttgagtaaatagagggttccgatatctaacaggatattagaacctaaatcccccagtccataggcaagtttttctttaaacggcaagcgtagggttgccggattcgatgatgtttgactcattattcttctccatctgcccgcaggtttccctgcgggcgagccgtattagatattccgtaaagaagcaaaaagtgaagcccactcgctcttcgcgcgatagaagaccggcggcttgccaatgggcgcatccacggtaatttcaccgccgtggtgagcttcgccggtccagatattcacccagtgatcttccggcaggtacagcgtccagtcgcaacgcccctgctcgtgaaccggcgcgaccagcagatcctgaccgagcagatattgatatttcagggtgtaggttgcggcatcgttctcgtaatgcaggaatagcggacgcatgaccggcagaccggtagccgcgttttgcgccaccgcctgcttgagatacggtttcagcgtggtaaagacggtggtcatgcgggcaaagtgggcaatagtttccgcgtcgccgtcgaactgccagttatcgccggggcggttgccttcatgggtgcgcatcatcggcgtaaaggcgctgaaatcgcaccagcgcagcagcaactctttgctgcgtttcatgtcaaacagggtggtgtagccgccgatatcgctgtgatgcagaccatggccggtcattgccagcgacaatgccgcaggcacgacagaggccagaccatcatcaaggctccagtcaacgttctggtcacctgcccacatcatggtggaatatttctgactgccggtgtaacccgcacgcataaagaacaggatctcgccgagcttgccggtctcctgtagcgcttcgtagttacatttcgcccagagcgcaggccaggcgttatgcatgatctcggcgctgacgccgttgtgcagatacgtgtcggtcggcagatattcgccgaaatccgccatccagccgctgcagccgagcgcgatcatgctctttttgatgacgtctttgaaccagtcgtaagcttcaggattggtcagatcgaccacgccgccatagaattcgccaaactcgaccagatagtcgccgcccgtggcgtctttcgccagatagccgtgtttcgccgcctcggcgcagaggtctttatcactggcgacgtatgggttgatataagagaggaactggacgccttcttctttccactgtttgatacggctatccagctgtggatagttgtcgctattccacttccagttccacatcacgcgcttgccaaaggaggtcatgcggataccggaccagtcctgcgcccaaataccgttcacttttacgcctgcgttgcgcatggtatccagtttttgctggcaaacttccgtaccgccctgaatgcctagcgtgacgccgtcgtaaacccagtccggcagctccggctggcgacctaacagcgcagtcagtttttccagcagggcgatgtaggtgtcggcacactcaaaacgtagcgtagttttatcttcccacagcgccagttcgtgatactccggcgcgctgaagtcgaaattcatatagcagctattatcgacgtggcagtaatacttctgcgtgctgacaaaggtcggttgcgggaagaaggtccagtaatagtcgccgccggcgttctctttacagtctgcctgccaggtgacatagctggttttattacggccaacgccctgttcgctggtccacagcgggaacggcttgccgcgcaaatcgaaataagagaactgttcgccgcagccgtagatatggtcgtctggattagctgcgagacgtaaccagatacggttatggtgcaggtcgtcgttttgcagatccagctgcaggcgtcccgcttcatcggcggagatgcgaagggtggcgctaattgttgcgccacggctgaattgtaccagccagccgtcaggtagctcgctgacggtggcctccgttaatgcaatcttttcgttaagtttgtctttgatgctaaagttgccgcgaaacatgtcaatgtcggcaacgcccgcgccaatccacagacagggattttcggtgctgtggcgtaaaatcaggcgctgttgccagctaagcgcaaaaccatcctgtgatgttgtcagttcaaaatcggttgaccgttgtggtagagaattcattgtaatctccgtgaatgtagggtaattcggtaatccatttgggctagtcgcagccgatggaaaaatgcagttgatggatcgcttttggggcaagatgaatcagtgcgatcccggaattaaatgcatcgggcgggcagctcataggctctaccgcgagaccttttcggctgagtttttcgccggtatagatctgtaaccagggctgggtgctgcgtaaaaatgtggacatgttctgcgttgggctggtaagtctgacctcccactcagccggggtagtcgcggtcttaaccgcatgatcaaggcgcgtttcgccgagcaggcatgatgcggaaaaatccctgcctgcgggcaattcttcgcttgcaggcagtgttaatacacagctatcgatgctttgcagattgcaagtcaaataaggatgcgcgcccgcgccataaggggctgattcatcgccaatgttttgcgtacgaatcaatacgtgcagcccactggcggcatctaaccgataaatcacttccgatatcaacgcaaagggatagccgtaagagggcggcagaaaaatcgttagcgacgcttccgtcgccgactgataattaatctgccagtctcgccaggctaacagaccgtgaatggcggtctgcgaaaccgggtcgttaacggcaagctggaaaaccttgccgttataggagtagcagccatttgtcacgcgatttggccagggaatcaatactttccccagatgcgccatgggtatttcttccggtttatgcgggatgaccacatggcgtccatgatgggtcagttccgccagacctgcgccaaccgtgacgattttcgcctggtaatggcccgcattaagctgaatagtttttccaccgctgtgcatggctgccatcctcatgacctatttcgcgttgatatccaggagacccgccgcgaccgccggagccaggcccggcgccagtggcagacgaggaatgaccagacagtgcagcagatggtaaatatcttgcttgccgtcccacactttggtggtcactttgttatcggcgtccagctcttgccaccaggaaccattttcatagtccatcaggtacttaatgcagtagtcccaccatttctgataccactcttcatactggctatcgtccgtcagggtgtagagggcgtaggccgtacccatcgcttccacaatcggccagcgcacgcgttcacgtacgataggtttaccgtcccagtcgactgagtagacaaagccgtctgcgccatctggcgcccaggcgtcgcggatagtggcatggaacagacctttcgcatcctccagcagccaggcgggtggcgtttcgaagcgggcctccagcgcagcatggagatggagcatcagacggccccactcaatccagtgaccgggcgtaccgccgtaggcgcggaaacggtgggcaggattatctttgttatagtcgcggatagggttccactgtgaatcgaagtgttcattgacgcggtaatcaccgttgcgcgccacatcatgaataattaccgacgcgatacgcagcgcgcgatccagccattttttgtcatgggtaacgtcataaacaatcaggaacgcttcgacggcgtgcatattggcgttgccgccacggtagtcttccgtctggctgaaggcttcatcccaggactccaggcacatctgctcttcttcactccagaagtatttctcaatcacttctatggtgtaatccagcaatttcctggcttcaggatgcccggtcgtgacggcgctggccgcgcccagcaaggcgaagaagtgttgataaccctgtttagaggcatctaccacgccctgatcgttaacgcaggcataccagccgccgtattttttatcgcgcagcgcgccgttcatggctttgatgccgtgatcgaccagatcataagcgcccggtcggcccatcgacgccgccacggaataaacgtgcagcatacgcgccgtgatccaaagatgggtgcccatctcttctttgatttgccctttatttcccagccagccgaagcctgtcggcaccacggcgtttttaccgaaattaaagatgcggtcggtttcctgctccagccagcggttgtggctcaacgtgttaaaccatttcattctgtcatcctcgtattaacgacgttttgccatcatttcatcgacgatctcgcccagacgttgcaatttaggcgcggaaacatcacgtagcatcagctcggtatccggtaaaccaattactgatgaccagaccgcgcgtcccgccaggaacccggatgcgccagcttccatggcgaccctgactgcgcgagggaacagtttttcgtccacaccggaagagaggatgacccacggcatattgatatgcccattcaggcgttgtgaggcggtaagaagatcggaacgtgcgcctttgccgtagagcggcatttcaactttgtaaagatcggcgccgctgtcgcccagctctttggccgcatcgataatcgcctgctcgcgatcgaacttgtcgccgcagcgcggcggacgtacaaccggttcgataatgctcagcaaaccattggagtgacataattcattgaattctttgaccatattcagacgctgctgcgcgtcttcgtcgctgcgccacagcaccaacagttttaaggctttcgcgccgtcccgttttaccgcctgcgcattaatttttttatcaaggaccacgttatcaacgggaataccgttgcccgggatgaaatcatccgccgcgacgatcatggcgcagcttttagcgaccgcgttttgttctacggcctggcgataacagaactgctgatccagcagaacggcagaggcatacggggaaagaattttcgccgcattcactttgaaatccgtcagcacgctatcggcaacgggtgttttcgcaccagcagcagcaaacattaaacgcatcgcctcgcgctgatcgacagccagcatggcaaacccgccggacgctcgcgtaatgtctttgatggtgtagttgttcattcaattttcctttatacagtcgttacttttttacgttggcggtcagcccggcgctgatgcgcacctgttccaggatggcgctccagtcttcccgaccgcggcctgcggcccgcgccaggttataaacttcacgggaggcggcgccgagcggcatcggtacgtgcagttgattggcgacatccaacgcgatgccaagatctttgtgcgccagatcgatcatgaaggcgggagacagatctcctttcatcactttattcggccaggtggtggtgaaatgccctttgcctgcggcagtgccgctcatcacttttaaagccacgtcgaaggaaagccccagcgcttcacacagcacggcggcttcggcggagagcgcatttagcgcaatactcatgtagttgttgatcagttttacgcgaatacccattcccgggccgccggtgttgaccagctcattacccatcgccatcagaacaggggtagcacgctctacttgctccgccgtaccgcctgccagcagcaacaatgtgccggtaatcgcgttgtcggatgtccggcctatcggcacatccatcatgctgaaccctttgctctgcatgtcggcaatcagattatcggtttgcaacggatgaatagtggacatatcaatgaccagcgcttcacgggaaagagtttcacaaacgccttgctcgccaaacaaaacggaacgaaccagatcgccgttcgggagcatggtgataacaaattcagcgccgatggttgcctgagccgggctgcttgcaggttgcgcgcctttgtctaccagacgctgtacggcgtcgggattaacatcgaagacgctgagttgatggccctgctttagcagattgctcgccataggggagcccatctgtcccaacccgataaatgctataactgccatatcgttctcctgaacacggtggtgtcattttttgtcattaatgagcatttttctgtctgtttgtgatcgtatttgtaatttatagtcaaaaaattgacagccgtcactttttaaacatttcgtgaaattaaaatgagcacatcgaaaatgcttgaggaatgaccatggttcgtattgcttgtgtaggtattaccgtgatggatcgcatctattacgtggaaggattaccgacagaagggggtaaatatgtggcgaagcgctatacggaagtgggcggcgggcctgcggcgaccgctgccgtggctgcggcgaaattgggcgcacaggtggactttattggccgtgtgggcgatgacgacaccggaaacagcctgctggcggaactggaatccctgggggtaaatacccgctatacccgccgctacacgcaggccatgtcgtcgcagtcagcgattatggtggatgccaaaggagagcggattatcgttaattatcccagcccggatttattacctgacgccgactggcttaacgacatcgatttttcgcagtgggatgtggtgttggcggatgtgcgctggcatgacggcgcaaaacaggcgtttacgctggcgcgtcaggctggcgtcatgactgttcttgatggcgatattacgccgcaggatattagcgagctggtggcgttaagcgaccacgccgccttctccgagccagggctggcacgcctgacggggatgagcgaagccattgatgcgctaaaaaaagcacaaatgctcacaaatggacatgtctatgtcacgcgaggcagtgaaggctgcaactggttggaaaaagcggcggtacgccaccaaccgggttttaccgtggaggtggtggatactactggcgcgggcgatgtttttcatggcgcactggcatttggcctggcaagcggatacgccatcgaagaggctgtcagattcgccagcggcgttgccgcgctgaagtgtacgcgcccgggtggccgggcgggtatccctgattgtgagcaaacccgatctttcttgtcactttttgtataatatgagcagtaggaagcttttagaggaatgctcatgagtcttaccgaactgaccggtaatccgcgacacgatcggctgttaatgctaattgatgagcgcggctatatgaatatcgatgagttagccagtttgttggaggtctctacccagacggttcgccgcgatattcgtaaattaagcgagcaggggctgattacgcgtcatcacggcggcgctggcagagcgtccagtgtggtcaataccgcctttgagcagcgagaggtctcctggacgcaagagaaaaaagccattgcggaagccgtggctgactatattccggatggctccacgatatttatcacgattggaacgacggttgagcaggtggcgcgcgcgctgctcaaccataatcatctgcgcattatcaccaatagcctgcgcgtcgcgcacattctttataataaccctcgttttgaagtgatggtgcctggcggcacgctgcgcccgcataatagcggcattatcgggccatccgcggcggcgtttgtggcggggttccgggctgactatctcgtcaccagcgtaggcgcgatagagagcgatggcgcgttactggagtttgatgtcaacgaagccagcgtagtgaaaaccatgatggcccactcgcgacatattttgctggccgccgatcatacgaaataccatgcttctgcggcggttgagatcggcaatgtgtcacagattaccgctctgtttacggacgagtatcccggtccggcattacagaatttacttcaatcccagcaaatcgaagtggttcaggtgagtccttcgctggacgacgccgtttcagcgtgacaagcgcccttgcgccggagggtcgcgtcagcgctttatccggccaataaaacggcgctgtgatgcaggcgatattgaacatcgtctgcgtttctattgtctttttgttaattgatttataaagggatacatagtcaaacttctcctttcccgctacagttattcatccccggttagcaaggagaatgacatgctctacatctttgatttaggtaatgtgattgtcgacatcgactttaaccgcgtattaggtgtgtggagcgatctgagtcgagtaccgctggcttcgctgaagcaaaaatttacgatgggcgagacttttcaccaacatgaacgcggtgagataacggacgaagcgtttgctgaagctttctgtcatgaaatggcgttatcgctcagttatgaacaatttgcgcacggctggcaggcggtatttgtcggattacggcccgaggtgattgctatcatgcataaactgcgcgagcaggggcatcgcgtggtggtgctatccaatactaaccgactgcatacccacttctggccggaggaatacccggaggtgcgcgctgccgccgaccatatctatttatcgcaggatttgggaatgcgtaagccggaagcgcgtatttatcagcacgtcctgcagaaagaaggtttttccgctgccgatgcggtctttttcgacgacaatgccgataatatagaaggggccaaccagttggggatcaccagtattctggtgaaggataaagccaccatccctgactatttcgcgaagctgttatgctaaaaaccgttcaccaaaaagctggacgccatacgcgccctgttcgggcctggctcaagctattatggcagcgtatcgatgaggataatatgacgactctggcgggaaacctcgcctatgtctcattactctccttagtaccgcttattgccgtcgtttttgcccttttcgctgcttttccgatgttttctgatgtcagcattcagttacgccattttatttttgctaactttatgccagccaccggagacgtgattcagcgctatattgagcagtttgtcgctaattccaacaaaatgacggcggtgggcgcctgtggactgattgtgacggcattgctgttgatgtacgccattgatagcgccttaaacactatctggcgcagcaaacgcacacggccaaaagtgtactcttttgcggtgtactggatgatcctcacgctcggcccgcttctcgctggcgtcagcctggcgatcagctcctacctgctttctttacgctgggccagcgatctgaatacggtcatcgacaatgtattgcacatccttccgctgctgctctcgtggatctcattctggttactttacagtattgtcccaacgactcgcgtaccgaaccgtgacgcccttgtcggcgcgtttgtcgcagcgttgctgttcgaggccggaaagaaaggtttcgcgctttatatcaccatgttcccgtcatatcagctcatttatggcgtactggcagtgatccctatcctgtttgtctgggtatactggacctggtgtatagtcttgcttggcgcagaaataactgtcactctcggggaataccgaaaactcaaacaagccgcagaacaagaagaagctgaccaaccatgattgcattaattcaacgcgtaacccgtgccagcgtcaccgtggaggacgaggtgacgggtaaaatcggcccaggacttttggtgttattgggtgtcgaaaaagaagatgacgaacaaaaagcgaatcgtctgtgcgagcgcgtgctgggataccgtatcttcagcgatgctgacggcaagatgaatctgaatgtacaacaggctggcggcagcgtgctggtggtgtcgcagtttacgctggcggcagataccgagcgcggtatgcggccaagcttttccggcggggctgcgccggatcgcgcgcaggcgctttatgaatattttgtcgagcgctgccgccagcaggcgataaacacgcaaaccggacgcttcgctgccgatatgcaggttgagctggttaatgacggccccgtgacattctggctccaggtatgagtcagcttccggcgtggccgcggataacaagagagagtacggctatgtatcaccttcgagttccgcaaacagaagaagaattagaacgttactaccagtttcgctgggagatgctgcgtaaaccgctgcaccagccgaaagggtcggaacgggatggctgggatgcgttggcgcaccatcaaatggtggtggacgaagaaggaaatttagttgcagtgggccgcctttatatcaatgcagataacgaggcgtctatccgttttatggctgtacatccctcggtacaggataaagggctggggacattaatggcgatgaccctggagtctgttgcccgccaggaaggcgttaagcgcgtcacctgcagtgcgcgcgaagatgcggttgagttctttgccaaactcgggtttgtcaatcagggggagattactacgcccacaaccacgccaatccgccattttctgatgattaaaccggtagcatcgctggatgatatcctgcatcgcggcgactggtgcgggcagcttcagcaggcctggtatgagcacattccattgagtgaaaagatgggggtgcgcattcagcagtacaccgggcaaaaatttatcaccacgatgccggaaaccggtaatcaaaatccgcatcacacggtgtttgccggcagcctgttctccctggcgacgctgaccggatggggacttatctggctgatgctccgtgaacgccacctgggcgggacgattattcttgctgacgcccatattcgctacagtaaacccattagcggaaagccaaacgccgtggctgatttggggtcgctaagcggtgatttggacaggctggcgcggggtaaaaaagcgcgtgtccagttgcaggttgaactgttgggcggcgagaccgccggagcaattttcgaaggcatttatatcgtactacctgcgaaaccgttcggcccgtatgaagagggcgggaatgaggaggagtagctggacatatccaactactcgatgaaggcatctgctggtagtttgaagcgttgtgtaagcgctttaatatgattaaccgttagtgctctgcggccatttaagatgttgctgacgttcgatttagaaccaagttcgttggcaagatctgctgctttgagaccgtattgatccatgagcgttcgcaatactgaaacgccagggggcgttttctccaggtgttggttgagtgctttgaattccggcgcatgtttttcgtattcactgattcgggcacagagcaattcaaatagtgggttttcaagatcgtcgtggtcgaccagaaactccactagcgctagtgccctgcgatactcattgtcatttcggtcttcccccatcagtgggacggtttttaccgcatcgctgaaggtatcaacgatcttttttgcgctggttgcatccatctgacgatgagttctcattctttattaccccgatagtatgcggtcagtttgtcatattcggcatgggaaacgatatgtttcacaaatatcttatgtaacctgaaatctatgtaggaaatgagtctcaggctgttaccagaaacatcaatcacccaccatttatctctgtacttaaaattatccagtgaaggaatataccgcttcatctcttcaggctgagtgaatgtttttttctccagaacattcagcaactcagtgagagcaagctcatggtttggatacatgagcatcgcttcattgaacggttttcggctgataacatgcacaatgtagttccattacaaagttttcaacctgaaaacaatttagcgcaacgttatccagttttcaagttgaaaacaaaattgaattttaggtcattttgcctgttgatggacttacaacacgccaggccacatctcgcatggcgcttcgtgccgcctggctcacgcctccgagctggaaaaagccatggatgacaccgagatagcgctggcaagtacattccacaccctgttcctggaaccgttgatacagggcctcgccctcatcgcgcagtgggtcgaattcggcagtaatgatgtgcgtggatggcagtccggcgaagtcctcacgccagagcggactggcttcaggatgcagtggatcggttcgcggcatatacatctcgtagcctgaaagcagcgtgtcacgcgtgataatgtaatccagcccattacaggtgtagctcgcaaacctggcggttgcgtccagcatggggtagatcagaatcagctgtgcaggttgccattgacgggcggctttcaggcgtagcgcggtgaccagcgccagatgcccacccgcgctgtcaccagcaagcgtaatgttctcgcgatctatccccagtttctgggcatatttccagatagtattggctccggtttcggcatcgttatgtgcggccgggaaggtgtgatctggtgcaagtcggtactgtgccgcaatcacgcgacaacggctgtaaaaagctaactgccttaactggttatcgtgagtggcaaaaccgccgctgacaaagcagccaccatgataataaatgatgcagggtaatttccctgtggcattgagcggcgaaaccacgcgaaacgtcatggcatcgagttcaatatcttcaacctggacgcgggtttctgtttctcctgccagtgtcgtgctggcgatgtagcccgccctccggtcatcaatattctgttcgcgagaagaggggcggcccgcggcgataaacccagcgaccagttcggcaattcctttttccagtggcatataacgctcctttgactgtatgtatgtacagtttataacctggttcgttggggatggaaagtggtgaaacgaggggataatgattctggatagaggttcgcaaaaaatggaatgcggttggcgctgggtttttaatttttgtactgtgaaacgatgatgctatacgccattgacgtatagattattttcactactataagccaatggcgtatggaatatgcaatttatagaaacggaactctttactgaagatgttaaaaaactgctcgatgatgatgaataccataagcttcaggtttttatggctcagcatccagattgtggtgatgtcattcaggaaacgggcggcctgagaaaaatgcgctggggagcgcgaggcaaaggaaagcgtagtggcgtgcgaattatctattttcaccgtagtcaacggtatgagattcgcttgcttctgatttatcaaaaaggcattaaagatgatctcacgccgcaggaaaaagcggtgcttcgtatgctgaatgagaggtggtagatggataaagtgttatttgagcgattaactcaaagtatgtctcaaatgaatgaaatcattgaagggacccgtgaaccttctcgtacctttcatattgatgcaatgaagattaaagaaatacggcaggcatctgggttgtcgcaatctaagtttgcagagctgatttcggtcaacgtggatacgctgcgcaactgggagcaaggaagacgttcaccgacagggccagccaaagcgttacttcgcgccattgccaacgacccgagaaacgttatacaagcattgcgttattgagcaatgatccggctaacgtagattgctagccggtataccagagaacttattccccttcccccgggaacaggaacgggttgatggaactgcgggcgaagccctcctgttccatgcgcgcgtccagcaccagcgaggcgaggtcgtcggccactgcttctactttcgggtctttttcctgatagagaatcttcaggtaagtcccgcaatcgccgcagctttcggctttcaccgcagcctgctcattttccagcgaccagtagtgtaagtcgcggctctgttcgcagttactgcattttacgcgcacgacatgccattcggtttcgcacaggttacagtgcagataacgcagcccctgcgtggtgccgatctgcaccatgctggagaccggcatcgaaccgcacaccgggcaatactggcgcgcttcaccgtattccgcgcgggctttgcctggaatcaagctggccatttgcgcccagtaaagggagagcgcggcccagataaagggggctttatcgctgctgacggaggcaaaatccgaggcaaacagcgcgctggccatctgctccagctcctgctctgaggctttctccaggttctcgatcaccgccagcgcggggccgctcatctcgggttttagctcggcaattaacgaatgcagcagtttttgccagtgcttatcacgcggcagcacgtggatatccagcggcggcttgccctggtcgttcgcttctttaatacgtgcggtcagatccatctccagcggatggtcgtacagcaccacttcctgcgcgtgcgcgataagcgcggcaaagcgcaggtaatcgcccagcgggttattttcagccagctcgcgcagacgttcggcgcggcggttgtagacgtttttgagtcgggggaacaataacggcggaatcatatccgccgtacgtttctcgctcgaccccagctcatcttgcgggattatgcgaatactcattcagtttctttttccgttgtcttgcggacttctcggtaccagcgcgggtgatgtttcttcgcccacgaccgggttacccagccttccaccatcgcggtaatggtgcctttcacccaaagggcggcgtagatatgcaccatgataaccacaattaacgctactgcggcaaaagaatgcaacattaacgcgaatcggatcaccgggattgagaaagcaggcgcaaagtacggacgccagataattaccccgctcaccagcagcagcaccaggaagataatcgccgcccagaatacgcatttctgaccgaagttataacgcccggtgtcacccacttcctcgttgacgacgatcttacgaatattcttcgcccaaaagatatcatcccgattgattagattgtggtgccaataacggaaaaacatgatgatgaacgaggcaaacataaccacgcccacaaacgggtgcagaattcgcgccagttgcggggtgcccaggatatgcatcaaccagttgaaggatgggaataaaaagcccagcccgctcaccgccgccagcacgaagcagaaagcgacgatccagtggttgatgcgttccggcgccgtatagcgcacgatggtgtcacgtcgtttcatttgcgcacctcgtctttctcttcatgcaggttgtcatcttcctcttccgcgcggttcgggccgacgccgacatagtggaagacgctggcggcaaaggtcgcggcaaaaccgaacgcggcgagcggtttccagacgcctttccagaacttaacggtttcgctgatttccgggttttccggcagaccgtgatacagattcggcttgtcggcatgatgcagcacgtacatgacatgcgtaccgcctactcccgccggatcgtacagacccgcgttgtcataaccacgggtttttagttccgccacacgctcgcccgccagcgttttcatatcctctttcgagccaaaatgaatggcgccggttggacaggtcttcacgcaggccggttcttgcccgacggtcacgcggtcaacgcacagcgtacatttatagacgcggttgtcttccgggttgaggcgcggcacgttgaacgggcagccagcgatacagtagccgcagccgatacactgctcggactggaagtcgacaataccgttagcgtactgaatgatcgccccttccgccggacaggccttcaggcagcctggatcggcgcagtgcatacagccatccttacggatcagccactccagtttgtcgttctgttccacttccgagaagcgcatcaccgtccaggatttcgcggttaagtccgccgggttgtcatacaccccgacgttattgcccacttcatcacggatgtcgttccactcggagcacgccacctgacacgctttacagccgatacaggtggtgacgtcgatgagtttcgccacctcttcctggtggtcccgcgcctggggcgcgggggtgaaaccgttagtggcggaacgacgaatgatgtcttgcgattgataagccataggtcgtctccgttacaccttttccacgttcacaaggaaggatttaaactccggcgtttgcgtgttcgcatcaccgacgaaaggcgttaacgtattggcgataaagccttttttcgccacgccttcgtagccccagtgaataggaataccgatggtatcgatatccttgccgtccgctttcagcgtgcgaatacgcttggtcaccaccgctttggctttgatatagccgcggttcgaggagaccttcacggtatcgccatgcgcgataccgagcttattcgccagcttctcgccaatttccacaaactgttccggctgggcgatagcgttaagcaacgcgtgcttggtccagtagtggaagtgctcggtcagacggtaagtagttccgacatacgggaacttatccgctttacccagcgcgtcggcatcgtctttaaagatacgggcggcagggttagagataacgttcgggtgcagcgggttagtgcccagcggcgtttcaaacggctcgtagtgttccgggaacggcccttccgccatcttatcgatagcaaacaggcgacccatcccttccggctgcatgataaacggtccgacgtcgctgccgggcgcggcggcgctgtagtccggaatatcccatccggcccattttccgccttcccatttcagtagctgacgtttcgggtcccagggattaccctgcggatcggcggaggcgcggttatagaggatgcggcggttaagcggccatgcccatgcccagcccagcgtgttgccgagaccagacgggtcggcgttatcacgacgcgccatcatgttgccttccggcgtccagctaccggcgaaaatccagcagccgctggacgtcgtaccgtcatcgcgcagttgcgcgaacgaactgagttgttggcctttcttcaccaccaccgcgccggttgccggatcgataagatcggccagcgctttaccgttactttccatcgccacttcttcagaggcgggttcgtatggtttggtgtagttccaggtcatattcagcacctgttccgggttggcgccgccctgttcagagtacatcttacgcaggcgtaagaagataccggcgaggatttcgccgtcggtcatggcaattcccggggcgtccgcgcccttccagtgccactgtaaccaacgaccggagttaacgatggaaccattttcctcggcaaaacaggtggaaggcagacggaacacttcggtctggatttttgcgggatcaacgtcgttcgactcaccgtggttttgccagaaggtggacgtttcggtgttgagcggatcgatagtcaccaggtacttcagtttggaaagcgatgcgaccactttgtttttgttcgggaatgaggccaccgggttaaagccctggcagatatagccgttgaccttgccctgtttcatcatctcgaagtactgcagtacatcgtaccctttgtcccacttcggtagccagtcgaagccccagctattttccgctgtcgctttatcaccaaagaaggccttcatcatcgagacgaagaatttcggatagttgccccagtagttgacctgatccttcaacaatggcttcggcgtattggcagccagataggtttgcaggtcggtctgtttttcgctcggcagcgtcagatagcccggcagactttgcgacagcagtcctaagtcggtcagtccctgaatgttggagtgaccgcgcagggcgttaacgccgccgcccgccatccccatgttaccgagcagaagctggatcatcgccatagtacggatgttctgcgcaccgatggaatgctgcgtccagcccagcgcgtacaggaacgacgctgttttatcttttgcgctggtttctgcaatgtactcgcacactttcaggaagtccgctttcggcgtaccgcagatattttctaccatgtccggcgtgtagcgtgagacatgctgtttcaacagattccagacacagcgcgggtgttgcagtgtcgtatcgtgtttggcaaaaccgttttcgtccagctcatagtgccaactggttttatcgtactgacgcttgtcggcgtcatagccagtgaacagaccatcatcgaagccaaaatcttcacgcacgatcaggctggcattggtataggcctcggtgtattcacggttgtatttttcgttggtcagcagatacagcatcacgcctgacaagaaggcaatgtcagtaccagagcgtattggcgcatagaaatcggccaccgacgcggtacgcgtaaagcgcggatcgatcacaatcagcttcgcgccgttgtgaattttggcttccatcgcccagcggaacccgaccgggtgagcttctgcggcgttaccgcccatcaccacgacgaggttggcgttcttgatgtcgacccagtggttggtcatcgcaccgcgaccaaatgttggagcaagacttgctaccgttggtccgtgtcagacacgcgcctggttgtcgaccgcgagcatacccagcgcgcgggagaatttttgcgttaaataacccgtctcgttactggatgcggaagcgcacagcatcccggtggtgagccagcggttaacggtaacgccttcggcgttctgcgcctgatagttggcgtcgcgatcttccttcatcagtttagcgatgcggtcaaacgcttcttcccaactgatttgttgccacttatctgaacccggcgcgcggtattgcgggaatttcaggcggctttcagagtggataaagtccaccagaccggcccctttcgggcacagcgcgccacggcttaccggatgatccgggtccccttcgatatggaaaatagatgctttggcgtttttcgcaccgtcgccgaggctgtacatcaacagcccgcagccaacggaacagtaggtgcaggtgttacgggtttcgcgggtgcgcagcagtttatattgccgtgtttccgctagcgctacgccgggcgcgaagcccagtgccgccgccgtggtgcctgccataccgccagcgcagatcttaaagaactgccttctgctgacctgcatggtttgctccttgtttcgacattgtcacttctctttcacatttctctatccgaaacgctcagggagtggttgttatttttctttgcggacgggcccgcaaaggttcagaattggataaattttcctccatccgggaggagttgtaacagaataccataatgttggtgtgtgtgttcttatatggttaaaagaaagtgaacaatatactgtctgaagaagtcctaaatgtgactgatttcacaacctcacgccagttgactctctggaaacgcgaggatttgcagtccccccaacttgatgatgttgccgaggaagtgccagtggcactggtgtataacggcatttcgcatgtcgttatgatggcctctccgaaagatctgacgcattttgcaatggggttttctctgtcggaagggatcattgacagcccgcgtgaaatctatggcatggacgttgtaccgtcctgtaacggacttgaagtgcagattgatctttccagccgtcgatttatggggctgaaagcgcgtcgtcgcgcgctggccggacgtaccggttgcggcgtatgtggcgtggaacagctcaatgacatcggtaagccggtgcaaccgctgccgtttagccaaacgtttaatctcggtaaccttgatcgcgcgttaaaacatctgaatgattttcaaccgacgggtaagctgacgggttgtacgcacgctgcggcatgggtcatgccgtcgggtgaactggcggggggccatgaagatgtcggacgccacgttgcgctggataaactgctcggccgccgcgctacggaaggtgaggaatggcggcaaggcgcggcgctggtttccagtcgcgcgagttacgaaatggtgcagaagtccgcgatgtgcggcgttgaaattctgtttgccgtctctgccgcaacgacgctggcggtcgaggtggctgaacgctgcaatctgacgctggtggggttctgtaagccgggtcgggcgacgatttatacccatccgcagcggttaatcgcagactaaaatagtaccctctacatttgcgtaaaatatatattttctcaattttacagcctctcttgataacggaatcacgtatagtggcgaggccatacaggttttaatcgtttttatgctggaccgcagcttattccagccattcacgaggcgcttgctacccggtaatacttcgaacgaaaaaagcgcccctggggcgctcttttggcagtcgctaacgacttatttgctcagtttagcggttatatgcacgcgatttgcagcgtgaaaagcttagaactcacgctcaagatgatagccattataggtgtcgatgagttcgttataagctttaaccacagcctcataagaaccatctaccatatcgccgctgccgctattgaggtagtcctgctcatgcgaggtatacgccacgttatcgcgcacgcgccgaatgcgttttttcaccttgccctggaatttttccagctcagaaataaagccagggaagctacgatgtttatctatatcaacgttgatcttctcgtttagcttctgagtatgctcttcaaaatcagcgagctgtttgcttactgccgccacatcaaaagaatcatcagctacagcgtcattaagcgtctcggcttcctgcatcgtcaaaagcgtatagtacttaatggatttaccttctttcttctcggtcgccttaatttcattagccgcatgctgcccactcataatggtaatctcggcgatatatttcttcgcaatgggatcaaactcatcgaactgttttataaacgttttatggaacgctttagcgccagcaaaggcatcatccttgaagttatcttgatcatagtatttattcatactattgattgtttcagctagtggcccagccgcattaataaatgccagagcagcactatccagagaggcaaacgccggctttaattcagccgccgccttgatgtctttccggcagtcctggataaatgcaggatacacaggaaccagcggagagggatcgtcttccttaccggtagggccggtgcggaaatcgtcgaatgtgttagcataacgatttacagcacggtaaatatctgcctggagattattataacaatcaatgtaaacattcagcttttggttaagaacatcgttcgcatctgcgctttccgctgatgtgggttgtgtattgctcgctgatgagtccgcactctgagctacaggttgttcgtccgcttttttttcatcacaagcgcttagcccggcagtcatcagcatagcgataataattgatgataacaaatcctttttcattagaataacctataaataatatcattgaaatttacagattcattttaatgaaaaaaaacaggtatgtgatttattcaacacaaaaaatacttaatgcatatttcattataattaacattatcaatatcaatgtgttcgttaaaataagagaaccccaacgtaaatatacaaaaggcaattaaatgaaaaggaatttattatcctcagcgataatcattgcgctaatgaccctgggcgcaacaggatgtgatgacaataatgttaaaaccgaggcgacgccggccgccagcagtcagcctgcgacgccagcgccttctcagacgccggaaacgcaatctggcgaaagtccagcgcagccctcagcagcgaagccagaaacggcaactcagcccccggtggcgaaaccagaaacgccagctcagccggaggttgacgctgaagaagtttatagtgaaaaaatggatgtctatatcgattgttttaataaacttcaattgcccgttcagcacagtctggcgcgttacgcggattgggtgaaagactttaaaaaaggtccgacagggaaagagagcctggtttatggcatttatggtattacggagtcttacataacgaattgccagaaagagatgaaacaggtggccgccttaacgccattacttgagcctattgatggcgttgccgttagctatattgatagcgccgccgcgctgggtaataccattaacgaaatggaaaaatattatacccaggaaaactataaagatgatgcctttgctaaaggtaaggcgctgcatcagacattactgaagaatatcgaggattttaaacccgtctcggaaaaatatcatgaggctattcaggaaataaatgacaggcggcaattgacacagttgaagagaatagaagaagcggaaggcaaaacatttaactattattctctggctgtcatgatttcggcaaagcagatcaacaaggttatttctgccgatacctttgatgccgaagcgatgatgaaaaaagtcgcggaactggaaacaatgattgcgcaattgaaagaagtgaatactgatggccgtaattcttctttcatcagctctgcggctgattatcagctacaagctaaaaaatatattcgtcgcatcagagacaatgttgagtattctgattttgaaaagaaacgggtgcaggaccctgcaacaggatggatggttgcggattcttatccggcgtcgttgagaagttataacgagatggtggatgattataaccgcctgcgttgagtgacggcacattaactgcgcacaggctggcgcaagtgcctataaaattacgcgataacgccaataaaaagcgccgatcaggcgcttttttcgttcatgtattcttcatcaggcaatatccgtaaaaatagctgacgtaaacattaactaaagagagttattagaaaaaccagtaatctgaagctatcacaagatgttgacgtcacgctggaaggtactggtagtgtcattgaggatcggcatttatatggaaagcatttatccccctgatgcgaaaattctgagctacttcagcatagggcggcccagccttcatcacttatagggtgtcacgtccaactgttctgtaagacgttaattaatacctgccagccgcaacagtgctgtcactaccgcagcggcgataatcaccacaataagcggcattttacgccaggctaaaaatacggcgaagccaaccccaagaacgcgcgccattccggcaaaatgttcgccttcgtaaaaggtggtcgccagcgcgacggagaatagcagcaccgttgccgcatccgagagcagcgcctgtgaacgctcagacagcgccagacggctgccaagtttcgcgccgccgaggcgcatcaaataggttcccgcagacaaaagagcaataccgataataaatagcgtcatattgcccattattttttcctcgccagtaggccaagcagcgaaagcaacaccggcaatccggcagccacaaaaggaacggcggcaagcgacagcgcggcgccgctgcaaccacgaatcaatgtggtgcggtttttaaacgccgggatcaccagcgccagtaagattgccgggaatacggcatccagaccgatggtttctggggccggaagcagtttgccgacaccagcgccaatcagtgtgccaatcggccagaatagggcgacgcccagaccgcatagccagtaggcggctttacgttgttcgggtgttttttgcgacaggccgaacaccacgctctcatcattcataatatggcagccgaaaaagctggcggcgcgggtgccaaccaaatcgcgcaccgttacgccaaacggcacgtggcgcgcattcaccagcagtcctgccgccgccgccgctaacggattgccgccgctggcaacaatgccgataaacataaattcggacgcgcccgccagcacaaaaatagagaggacaaacggcacccacagtgggaaaccgtaggccatcgccagtgagccataggacatgccgacgacgcccacggccaggcacactaaaaatatcgcttttatcgtgtctcccttgagacaggaaaaatagtgtttcatcttctttagtcatatcgaacgaattttcattataatgaacggaacagatttgctttacaagacgaacatttcgttcgttatagtgaacgttggatgctttatgacacaacctattagcgtcattgccagaagtctggtacgcgaacgccagcgaaccggactgtcgctggcggagattgcgcggcgcgcaggcatcgctaaatctacgctttcacaactggaagcagggaacggcaaccccagcctggagacgttatggtcgctatgcgtcgcgctcgacattccctttgccaggctgctggagccgcaggtacaaaaaacgcaggtgattcgccgcggagaaggcaccaaagtggtggcggagcaggcgcattatcaggcgatattactggcggcgtgtccgcccggcgcgcggcgtgatatctatctgctgttgacgcagccgggggccgaccggatctctcatccgcatccgccggggtcggtggaacatattattgttacgcagggaaaagccctcgtcggcttaaccgaggcgccggaagagctggcggagggcgattacatttgttatcccggcgaccaggcgcatatctttaaagcgctggaaccggatactcaggctatcctggtagcggagcagaattgaaattgccggatggcggcgtaaccgccttatccggccgacaaaaaataaaaccgtaggcccggtaagcttgcgccatcgggcacacgacttactgcagatagaacacctcttttagctctgcgctgaccgggctgttatccggattcgcgggcataacgtcacgcatatgtttccaccaacgctggcaaacgtcggtgctggcaacggcgttccagcgctcctcggattcaatctcaacggtggcgaacagcagattgcgctcctgatcgagataaatcgcgtagtgatgcgcgccgtgagattttaatacggcttccagctccggccagattgggttatgacgacgctgatactcctcgtgcgcgtcggcatttacctgcatcacaaaggctttgcggatcataacgcctccaggtacagcccgcgaacttcatcgcggctggcggtgcgcgggttacacggcgcgcacgggtcggcgagggctttatccagccagccttcgatatcttcttttgtgacgcccagcttgctgaaaccttctggaatgccgacgcgtttgctcagcgtacggatagcgttaatcgcttcctgacttgcggcttcgtcagacataccgcgcgtctctacgcccatcgcctgtgcgatacgggcaaaacgcgcgacggcgttcggacggttaaagttctcgacaattggcagcaggatagcgttgcagacgccgtgcggcaggttgtgagttgcgcccggctggtgcgccagcgcgtgaaccagccccaaaccggcgctgttgaacgccatacccgccaggtactggccgaatgccatttgctcacgggcttcgaggttatggccatcgtcaaccgctttcggtagccacaaattgattaagcgaatcgcttccagcgcgttagcgtcggtaagcggatgcgcgccaacggagacataggcttccaccgcatgggtcagggcatccatgccggttgcggcggtcacagacgccgggatttccagcatgacgctggcgtcatccacggcaatatccgggatgatattcgggtcgatgatcacctctttgaccttacgggcagagtcgataatcaccgcgttgctggtcatctcggccgcggtacctgccgtagtattaatcgctaccagcggtacgccggcgtttttcactttgccgacgccggagtaggcggtggaagggccagggttggcggtgaggattttcaccgcttttgcggtatcgatcgggctgccgccgccgaaggcgataatgtagtcacattctgcgctctgatacgccgcaaaacctttctgcaccagctcttctgtcgggtttgggaacacctcatcaaacaggtggtaagacatttgatgttcatccagtgcgctaaacaggctatccagcaggcccagctttaccagttgaccatcggtaacgatcagcgctttgccccattgcttattcgccacgaggttcaccatatcggcaatcgctccagcgccatgcaggctaatttttggcagtgccaacataaagctcatcactattctccttaaaaaaattccctgttgcccgatggcgctacgcttatcgggcctacggtaaaatgcgcaccgtcctgtaggccggataaggcaaagccgcatccggcgttgagttgggaggtatcagtacagcgctacggcgctggccagcggtgtcacaccaaaacgtttgccgagtgcgaccagttcttcgcgcgtgatggtctgcttcataccgcccatcgaatagattttgactaatacctcagcggatttctctgcggtatctatcaaaccgaaggtttcatccagcgtaggtccgcttccgaacacgccgtggaacggccacagtaccagcgaatgtttctgcatttcttgcgcggtagcctggccgatttcatcggtgcctggcaccatccacggcagaatgccgacaccgtccgggaataccaccaggcattcggtgctgccttcccacagtttgcgggtgatcagcgcagtgttgttttccagtacgtaggtgagggcgatcaggttagtcgcatggcaatgcataatgacgcggtctttgccgtgggtggctttgatgcgttcgcagtgggagaggaaatgcgccgggagttcagaggtgggtaccgcgtcgtgggttaagccccacagaatgtggtagcctgcgccgtcactgtcgattttgaccacgcctaaattggctgccggatcgagctgcacgttgcggaagaatttgccggaaccggtaacgataaacggcgtattcgccagcagcggcatgggttgacttagcgcgatgtagcgcggtttttcgtggaaattagctgcaaacggtgcgatatcggcttcatccagacgcagcgtcaggttaccgccattacgttcgtcccaccctttcagccacgcatcagacgtggctttaatcatgccctggacgaaccaggaatcggtaatattttgcatgttcgtgttcccatttattgcccgaaggttattcgggtcttacgtaggccggataagcgcagcgccatccggcaatcgtgtttcatttattgccggatggcgacgcgggcgtcttatccggcctacagatcaggtgtcgctgtcagctacgtttgctcaggatctctttttcatagacgcgaacgctgtccagccactggctgccagccggcgtgtcgtgacgctggcaatacatttcccagacggcctgccacggcagagatttttgctcttccagcagcgccagacgcgcggtgtaatcgccgctggcctcaagctgacgcagttgatctgtgggttccagcagagcgcgcagcagcgcttttttcatgttgcgggtaccgataacccacgcggcgacacggttgatagaggcgtcgaagaaatccagaccgatatgcacacggtcgaacaggttatgacggacgatttcgctggcaattgcctgggtttcatcgtccaggagtaccacgtggtcgctatcccagcgtaccgggcggctgacgtgcagcagcagccgtggcacatagagcatggcggcggaaattttgtcggaaatcacttcagtgggatggaagtggcccgcatccaggcacagcgcggtctgacggctggtggcgtagcccatgtagaactcattggagccgacggtgtagctttccgcgccgatgccaaacagtttgctctcaacggcgtcgatgtggtgcgccgggtcgaatttctcgctaatgacctcatccagcgcttccagcaggcgctggcgcggggctaaacggtcgacggtaatgtctttcatgccgtccggaatccagatgttcatcaccgacggcgtaccgagctgctcaccaaagtatgccgagacgcggcggctggctttgcagtgatcgatccagaactggcgaattttcgcgtctggatgagagagggtaaaaccgtcagcgctcagtggatgagaaaaacaggtggggttgaaatccagccccagccggttcgctttcgcccactccacccagtttttaaaatgctccggtttgatctggtcgcgagcaaccggcgtatccgactcaaggtaaatggcgtgtaggttcagccgttttgggcctgggatcagacgcagcgcctgttccagatcggcgcgcagttcggtggcgttacgcgctttgcccggatagttgccggtcgattgaattccgcccgtcagcgaaccttccgggttctcgaatccggcaacatcgtcgccctgccagcagtgcatggaaaccggcaggcgatcgagctggcgcagcgcctcctcgacatcaatacctactgcggcgaaacgttgttttgccagttcccaggcttgttccagttgagtggtcatgcgcaaagctcctttgtctgtcgtttgggttgaaactgcgcaacgtggcgggcaatttcactatcaggattagggatataggttgtcaggtcgtagttagcgctgacgacctgacggaagtcatcgacgttgtttaattcgtcgagggtcataagctgaataccaatattgccaagggtggaggcttcaaccggcccggccatcacgcgaatgccacatgcatcggcgcacaactggttgagtagcgagttttggcatccgccgccgacaatatgcagttgggtaaatttttcgccgcgcagatttgcctgttcgtgcagaatgtcggcatacaacagcgccagactgtcgaaaatgcagcgcgccagttcggcatcgctgacgggaacgggctggtcggtctcgcgacaggctgcctggatttcagcgcgcatatcgtcaggattgataaagcgatcgtcattcgggttaatcaggaaacggcaggccggcagcgcttctgtttgggcgataagcgcaggcagatcggtaatgcgccgttctttcagcacacgctggagcagccacaaacccataatgtttttcagtacccgataacgcccttccgcgccgccttcgttggtgatattggcggccagcgcctcatcagtggtgtagggcattttgctttcaaaacccatcaatgaccaggtgcctgaagacaggtaagcgctatgtttatttgccagcggagaggcaataacggcgctggcggtatcgtggctggcgacggctaccaccggaatacggttgccctgcgggcaaatccagtcgccgataacattgccagggtgcgaggggcgaccgaaccagctctttttcgcgccagtccacgccagcagggtatcgtcccagtcatcggtattgatattgaccaactgggtggtcgtggcgttggtgtattcccagttcatttcaccggtcaggcggtagctgaaataatcgggcatcagcagcgcatgagcgacctgcgccgttaactcaggctgttgtttcgtcagcgcgcgtagctgatagatggtgttaaacggcagaaactgaatcccgctgcggcgatagatttcgcttttgccgatctggaccagcgcttgcggcatgatgcccgtggtacggttatcgcggtaggagaccggcaggccgacacgctgaccttgtttatccagcaggacataatcgacgccccaggtgtcgatgccgatgctgtcgataagaatgccttcattgcagactttcttcagaccaagacggatatccttttccagactgtcgatgtcccaggtgtcaaacccgtctgttttttgtaggcagttcacaaaacggtgaatttcacgtagcgtcagggtacggtgtttgctgtcgtaacgcgccagcatcacgcgcccgctggatgcgccgagatcaaccgcgacacaatggcgaaaagtcataatcaggtccttcttagagtcattgcgcacagtctaaaaaagccctcaaagacctaccttctcgttactgacaggaaaatgagccgctggcaacaaggcaaagatgaacgtgatagcgttcacagtttctactaataggccggtgtgatgtcgtccgcatttcccgctttttcccgccttttcttgaaaaaaagaccatgtttgcgcgctttagcgtcaaaaatttaaggtgaggccgataacccttaattactattcggacatgttgaattcaggaggaagcaaccatgaccgtactgcatagcgtggatttttttccatcaggtaaagcgcccgtggcgattgaacctcgtctgccgcaagccgctttccctgaacatcatcatgattttcatgaaatcgtgattgtggaacacggtacgggcattcatgtattcaacgggcagccgtataccatcagcggcggtaccgtgtgttttgttcgcgatcacgaccggcatttatatgaacataccgacaacctatgcctgacgaatgtactgtggcgttcaccggacgccttccagttcctggcggggttggatcaattgctgccgcaggagcaggatggttactatccttctcactggcgggtgaatcagagtgtgttgcagcaggtgcgccagttggtcggtctgatggagcgcgccggagacggcatggatgcgcctgccgtggcgaatcgcgaaattttgtttatgcaactactggtgttgttacgccgcagtagcctgatggaaggcgcgaccaataacgacgccaaactcaaccaactgatggcatggctggaagaccattttgcggaggaggtctgctgggaggcggtagctgaacagttttcgctgtcgctacgcacgctgcatcgtcagcttaaacagcataccgggctgacgccgcaacgttaccttaatcgcctgcgtttgatcaaagcccggcatttattgcgccatagcgatcatagcgtgacagaaatcgcgtaccgctgcggttttggcgacagtaaccacttttcgactctgtttcgccgagaatttaactggtcgccgcgggatatccgtcagggacgcgatgcgataatccagtaacgcgaacgctatcaacgttttcgtcgccaatatgctgataattataccctttaataccggatggcggctgcgccttacctggcctacggcggcgagcggtagacagaataagcgtagcgccatccggcaagcattcaacatgaggtgctgcggtggcaaatcagttaatccttttgaaaaaagatttttttactgatgagcagcaggccgttacggttgccgatcgctatccacaggatgtttttgcggaacatacgcatgagttttgtgaactggtgatggtctggcggggcaatggcctacacgttcttaatgagcgcccatacagaattacccgcggcgatctgttttacattcgtgctgaagacaaacactcctatacttccgttaacgatctggtgctgcaaaatattatttactgcccggagcgtttgaaactcaatgtaaactggcaggcgatgattcccggctttcagggagcgcagtggcatcctcactggcggctgggcagtatgggaatgaatcaggcgcggcaggtcattaaccagcttgaacatgagagtaatggacgcgatccgctggcgaatgagatggcggaattgctgtttggtcaactggtgatgacgttaaaacggcatcgctacgcgaccgacgatcttccggcaacctcccgagaaaccctgttggataaattaattaccgctttggctaatagccttgagtgtccctttgcgctggatgcgttttgccagcaggaacaatgcagcgaacgggtgctgcggcagcagtttcgcgcccaaaccgggatgacgattaatcaatatttacgccaggtccgtatttgccacgcgcagtatctgcttcagcatagcccgctgatgattagcgagatttcgatgcagtgcggttttgaagatagtaattatttttcagtggtgttcacgcgggaaaccgggatgacgccgagccaatggcgtcatctcagtaatcaaagcgattaactggccatgcctaaaccgacaatattcgccgcgataataattaccacgcagccgaggcttaatacagcaacgggacggcggccagcatttttccactcttttagcaccagaccgacaagccccccgcacagcacatagaagctcatgtgcagcatccagctcatgtagtcatattgcgctggaatgcgcgcgtgaccccaggcatagaaaaagaactgcaaataccacatcagaccgccaagcgcggacagcagaatattgctgataatcaacggtcttgccagcgagaagtcggcttttatcgacagattttgtacttttgccaggcggataaaacagaaaccgaggttcaccagcgcgccgccgcccataatcaccacgtaactcggcagcgcgacatagagcgggtcaacgccaagcgcggcagcagcttcatgcatcggtttcgcggcgttcatggcaaaagacattcccgccgagaaaataccgcacatcactgccagcagaagccctttcttcagattgaactcctccgctttaatgcccattttgcgttcttttaactgtccggcgcgcgtcacaatcccgacgccgatcagcgcgacaaaaacgccaagtagcgtcatgcgtcccccttcggtatgaattaacacatcgaagttaccgttgatgataggcgtcatcagcgtgccgacgataagcgtaatgccgatagcgatgccgatacccatcgacatgccgagataacgcatggtcaggccgtagttaatattgccgatgccccacatggcgccgaacagaaaaaccggtaaaagggtggagaggttaaactgcccataataggcccagaaatcaggcagtaacagagcgctaattgtccacggcagaataagccatgagacgatgccgcccactgaccacatggtttcccatgaccactgtttcacttgcttgaacggggcatagaagcaggctgcactggccgcccctatcaaatgccagaaaatacccatcgtaatcgcgttactcatgacatgttcctcattattttttatggacgggataccccttccgtttgcatgagtttaaaaattacgcagcctggtaaccttataacgattgccgccgttgggtgtattctggcaatcagcacgttaatgaagtgattaacttcacgttttaaaaaagtcggagcgcatcgtgaccgtctggatgttatttaaatcagtgggtaatatttgttttctaaaataccttcatcataacgacacgaaacgacttagctggcaacaatgcaaagaaaacgctgcgtgaggtcacataatgggaatagtctgacttaccgtttgataaaagggtagttatacagtaattatttggttgttttatttgtatttacaatttaaatatattgaaattaacgttaggaatcaattaaatataaatataaggaaatccctatattggcgttgttgatggtgttttgatttttattttatatgacgaatatgaatttcatttattttattttgctttttgaacattatcccaattttaaattaaagatctttgtctatattgtcgccattcacattgcgtattatggttgtaacggtctgacatgaaacaacgttttaattttaaattaaatggattctgttatgagaaaatctcttttcttactattacctcttgttgtaacaaatgcgcatgcagtatatgtcgatgttcgtcatgaatatcttgatgacagtaaagctaactatgaccgtgcgtatatttctcatcggtttgcgaatggtgttggttttgcgatagaagctatctcaaaatcaggcggggatgacaccaataaagcgtttaatgacctagaaacacagggcaacgaatatacgataagctaccaatttaaaaccggtgatgtcgcctggcaaccgggtttcgtgctggaaacaggcaacggttactctacctataagccttacttccgcgcgacgtggacattaaatgaaagctggtgggttggcgcgcgctatcgttttgaatatgtacgccgttcttctgatatccgtgatgatgataccatcaatcgtatggatgtctgggcgggttataaatggaacaactttgactggacaatcgaaggaatttataagaaagccgataaatatgatctttacgatggcggcaaagataactatgaatataacttcagaactgcctatattattgaccaatggtcgccattcgttgaggtaggtaatgtttccgtcaatagcaacagcgatgaaagacaaacccgtttccgcgtgggtataggctacacattctaatcattatccctgtttattatttattcccttttccggctactttataggtagccggttttttttacctggtgatgacctgcggataattattatcgcgcgttggccggataagacgcgaatcgccatccggcaacgagatgtgcaggaaactatgcgcttacatgatgcccagtagacggggtaagaacagtgtgatttccggaatgtaggtaattaataacagaacgccgataatcgcgccgtaaaaaggcagcaacggtttaatcacttcctcaactttgaccttaccgacgctcgccccgacatataaaccactgccaactggcggcgtaatggtgccaatcgccaggttatagatcatgataatgccgaaatgcaccggatcgacgcccagtttagccatgattggcagcagaatcggggtaaaaatcagaatggccggaccaatatccataaatgcgccgataatcaacaaaaagacggtaatgactaacaggataaccagtttattggcggaaataccgaggatcatatcgctcagcgccgcaggaatattggtgatcgacatcgagaaggacatcgccgaagaggttgccagcaggaacatgatgaccccggtcattaccactgtctggagcaaaatcgaaggcaaatccttaattttcagcgtgcggtaaaacaccatcgtcagcaataacgtatacaccacggcaatcgcggaggcttcaatggcggtgaaaatcccctgcacaatgccgccgacaataatcacgatcagcagcaggctgggaatggcctcaacggcaacttttagcgccatacctttttggacggtgaagaaaacccgataatttcgacgcttagcgaccaccagcgtgaccagcatacagccaacgccccacagcactcccgcgaccagaccgccggcgaacagagcggcaatcgatgttcccccgcttgccagcgcgtaaaggataaaagccgtggtgggcggaattaacattcccgtcggcgcggaggcgatattcaccgcggccgcaaagccgcgatcgtaaccttcgcgcgcgctcatcggcaccatcacgccgccgatggaggttgaggcggcaatcgccgatccggaaattgcaccgaacatcatattgccgacgatgttggtataagagagcgagccgggcagtttgccagtaaacagtttggcaaaattgaccagccgggcggcaattcccccgctattcatgatcaccccggacaaaacgaagaacggcacggccagcaaggcaaaactgtccaggctggagaacattttttgcgcggtggcgaacatcgaaatatcgaaaggcagtaccagcatcatggtgctgaaagaggcgataacgatgcagatcccgataggcgcgcccatggccagtaaaacaacaaagacggcaattagcgtacaggacgcaaaaatagggtcaatcatgtgatttctccagagtgtgctcagtggtatccgtggcggaatggatagctttcagggcgtcaacgatattcagcagcccatagaggatgatcagtacgcccgcgcaggggagcgcgtaataaatttttcccatcggaatgcccagcgcaggagagatttgcagcatagaaatcgcagaaatctttaagccgccgataatcaatacccaaatggaaaacgcgataaaaatgacctgcaggataatatcccaccagccgcgaatcgtcggcgacaccttatccagtaagagagtcaggctaatatgctgtttctgaccggcgacaaaagccatgcccagcattgatacccacaccaggagaaatcgcagcatctcttcggtaagggtgctgggaacgcccagaatgtagcggctcaccacctgccagcaggcgatgccaaccattatcgccagcaccaggcaacagatagcgcccagcaataaatcaagtccttttctgaatgtgttcatcttaatttcctgattagattaattttttgctgtctggatacgttgatacagcccgtaaagccgcggtttgtttttcagaccgtcgtaaataggctgtactgcctcctggaagggttttttgtcgatctcgtagaattcaacgttgaaatcttttaccgccgccagcctggttttctctatttccttgtcccatgcggctttctcaaattcgatcgacgccttgatggcggcttcgacgatgcgctgctgttccggcgtcagcttttccagcgtgagggtactcattagcaggatatcgggaatgcgggtgtgcatatcgtaggtgtaataacgggcgacttcgccgtggcgggcgatggtgagagcgaactcattgttttccgcgccgtcgagaatgccttgttgtaatgaggtatagacctccgcctggctcatggcgataggcgaagcgcccagcagtttgagggtttggatcgccgtctcactctgcatgacgcggatctttttcccgcgtaaatcctcaatgcgtttaatcggcgctttgctcatataaaaattacgcgcgccggaatcataccagcctacgccgataaacccctgcgcggcggtggactgataaacaggctccatcacctgcgggttatccattacgcggtagtattcctcgacggtggcaaacaggtagggaagtgagaacacgccgtactcaggcgaaaaactctccatcagcccggacgacactttagtgatgtcgacgacgccgacctgcgtcaactccaccagttcgcgctcgccgccaagctgtccgtccgggaagtactgtactttgatatcgccgcccgttttctcttccacttgctgccccaggaagtgcaacgcatcttttaccggctggctattttcagcgtaggccaggcgcaaaatggtttcgccgtgggagaagaaagagagtgtggagagtaaggccaacgtagccagacgtataaaaccaggttgcttcatgattccctcgcaattgtaataatttaccgggaatgtaattgcagtgtgaaattataaccttcttgattttgccaccgctgacaaaatttggcaccaaaagaaagattttgaaaccctgtttcacatttcatgatttccaggaattcatcaacaggcggtttcggttggaggcgtaaaaaacggtttttttcagcggatgccgtaacgtttataaccctggaaaaagtacggcattgataatcattttcaatatcatttaattaactataatgaaccaactgcttacgcggcgttaacactgtgccgctcgacaataatggagatgattatgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgccagcctgccggttgaagaactgattactaaactggaccaggtgccagcggacaaaaaaactgtgctgcgtaacaacgcgggcggccatgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggcctggacgtgtgggaacacgcttactacctgaaattccagaaccgccgcccggactacatcaaagagttctggaacgtggtgaactgggacgaagcagcagcgcgtttcgccgctaaaaaataatttgcattgcacgtctgtagaagcgagtctgatgactcgctttttttgtatccgcgtaaggagcagcagatgcattatccggttgacgtgtttattggcaaaattcgtgactatgacggcagccgcccgagcgctatcgccaaggtgcaaatcgacggcgaactcatgctgaccgagctcggtctggcaggcgatcagcaggccgaaaagaaaatccacggcggccccgaccgcgcgctatgccattacccccgcgaacactatgctgattggattcgccagttccccgagcaggcgacgctgttttgcgccccggcgtttggcgagaatctgtcgacgaacggaatgaccgaacacaacgtgtttattggcgacatctaccgctggggcgaggtgttgatccaggtcactcagccgcgctctccatgctttaaacttaatttccactttgccatcagcgacatggccctccttatgcagaacagcggaaaaaccggctggctgtatcgggtcattgcgccaggtaaggtctccagcgatgcgccgttggaactggcgtcgcgtctgagcgatgtctcggttcatgaagcgggtgttatcgcctggtctatgccgtttgatgacgaacaatatcaccggctgttgagcgccgccgggctgtcggcgagctggagccgcaccatgcagaagcgtcgtttgagcggcaaaattgaagatagcgccagacgactgtggggggataaaactccgccaaaatgaaaggaaggattatgactgaagctgaaaatgcggtggcgatcgtaaaagaatttttggtggcctcgatgattcccgatgctgaacgcgccgcaacgtatatgcacccggaggtgaaaattaccttcaccggaggccgggcaatggctggcgcggcagatatcgcgcagtttaacggcgctcgctacaagtgggtgaagaaggcgctgggcgagtttgatgcggtgcagcatgatcattacgttgtgatttattccaacggtacgctgtatggggaatggcccgacggtcgcccgtttgccggtaatcgctttatcgatcgtttcgaagtgcgcgatggcaaaattacccggatggacgtgtggaacgacagcgccgagtggattctggtgccggaaatctcccggtaaatctcgacggcgagataaaaaatcggcctgcattcgcaggccgatggtttttaggttcgcttgtacagcggtagccacagcgtaagccgcaacccacccagcgggctatcgtcagccttcacccagccgcggtgctgctgcatggcgctttcgacaatcgccagccccagcccggtgccgccagactcgcggtcgcgcgcctcatcagtgcgatagaacggacggaagatctgctcgcggtcttcagggctgacgcccggcccgtcgtcatcgaccgtgatcgtaataccgtctttatccaccgagaagccgacttcaatcttcgtatgtgaatagcgcagcgcattacgaactatattttccagcgcgctttccagcgcgtttgggttgccatagagcggccacggccccggcggataatttaccgttaacgacttgcccatctgttcggcttcaaaggcggcgttatccagcacttcgccccatagctgattggctttcatcgtttcgctgaccagcgcatttttctgttggttacgcgacatcaccagcaggtcattgatcatgctgtccagacgctgcgcttcggtttcaatacgctccagctctttgctttcgccgccacgacgacgcagcagcgcggtacccagttgcaggcgcgtaaggggcgttcgtagctcatgggagatgtctgacagcaaacgctgctgcgaggtcatcatccgttccagcgccgtcaccatctggttaaaactggcgccagcggcgaggaactcctgcggacccgcctccagctccggatgctgacgcaggttgccttgcgccacttcatcagccgcgtttttcaacttacgcgccggtttcgccagactccatgccagccatagcaagagcggcgaactgaccagcatcgtgacaatgagcaacagaagcgggcggtcaaacagcagattaataaaatcggattgcgaactgctggccggtcgaatcaagtaaagctggtaattatcctctccgtcgcgaacggagaacggccccaccatctctacgcggccatattttttcttctgcggatgatcggcgttatccgcctgaccaatgaagttacgaatgatctgcatttcgctgcgttcagcgccgatcacgcgtccttcagaggtcaccagtaataaccgctgtccaggcggcgcccacttatcgatcgcgcggaacaggcgacgccaccacatcaggtcgttgggcggatcgttcgcaagttcagcttctacatgttgctctatcatcaatccctggcgctgttcgctgtccagcagctcggtcatctggcgtgaatcgagcttgggcaacatcaggaccagcattagcaccagcgccagcgtcaaccagaagatggcgaagatgcgcgcggttaaacttcctatcatgaagcggaaaccatcagatagccgcgaccacgcaatgttttaaaccacgggtgaccgtctttgcgttccggcagtttgcggcgcaggttagaaatatgcatatcaatggcgcgatcgaacggcgtcaggcgcttacccagcacttcctgacttaaatgttcacgggaaaccacctggccgaggtgttgcgccagcaaatagagcagggtgaattccgtaccggtcagctccagcgtttggccatcgaaactggcttcctggcgacccggattaaggcttagcgcatcgacttccagcgtcggcgagccgttgtcgctgctctgctgctgttcgctccagtgggaacggcgcaaaatagccctgatgcgcgctaccagctcgcggtcgttaaatggtttgggtaaatagtcgtccgcgcccagctcaaggccgagaacgcgatccagctcgctgccgcgcgcggtcagcataatgacaggcgtctggtgtgtctggcgaagcgctttcaacgtatcgataccgtttttcttcggcatcatgacgtcaagcaaaagtaaatcgatgctgtcatccaaaagctcaagcgcctgctcgccgtcgtgggccaccaggacattaaaaccttccatttcgaggagctcttttaacagggaagtcagctctcggtcatcatcaactaacaggattttattcattgtttacgtacctccgaggcagaaattacgtcatcaggcgtcgctaatccatgactttacgttgttttacaccccctgacgcatgtttgcagcccgaatcgtaaactgtctctcgttgaatcgcgacagaaaagattttgggagcaagcgatgcgcaaagttaccgctgctgttatggcctcaacgctggcattcagttttttaagccacgcagctgaagttgttacaagcgataactggcaccccggtgacggggccacgcagcgtagcgcgcaaaatcatatgtttgacggcataagtttaaccgaacatcagcgtcagcagatgcgagatcttatgcaacaggcaaggcacgaacagcctcctgttaatgttagcgaaatggagacaatgcatcggcttgtcaccgcagaaaaatttgatgaaagcgctgtgcgcgctcaggcagaaaaaatggcgcaagagcaggttgcccgccaggtcgaaatggcccgcgtgcgtaaccagatgtatcgcctgttaacgccggagcagcaagcggttttgaatgaaaagcatcagcaacgaatggagcaactgcgcgacgtggcgcaatggcaaaaaagttcatcgttgaaattattgagtagtagcaactcacgttcccagtaacaaccctgttttccttgccatagacaccatccctgtcttcccccacatgatgtgggggttttttttatctccagtttgtcattctgttattagcttactgttttaaaccatccgttatactaccggcagaagatagcgggagtatttatgaatcaaacctatggacggctggttagccgggcggctatcgcggcaacggcgatggcatcagcgttacttttgatcaaaatttttgcgtggtggtatacgggatcggtgagtattctggcggcgttggtggactcgctggtggatattgccgcgtcattgacgaatttgttggtcgtgcgttattcgctgcaacccgcagatgatgaacacacgtttgggcacggtaaagcggagtcgctggcggcgctggcgcaaagtatgtttatttccggttcggcgttgtttctgtttttgaccagtattcagaatctgattaagccgacgccaatgaacgaccccggcgtggggattggcgttaccgtcatcgctctgatatgcactattatactggtcacgtttcagcgctgggtggtacgcaagacccaaagtcaggcggtacgggcggatatgcttcattatcagtctgatgttatgatgaacggagcgattcttatcgcgctggggttatcctggtacggttggcatcgtgcggatgccctgtttgcgttaggtatcggcatctatattttgtatagcgcgttacgtatggggtatgaggcggtgcagtcattattggatcgcgcgctgcccgatgcggaacgacaggaaattattgatatcgtgacgtcatggccgggagtcagcggcgcgcacgatctccgcacgcggcagtcagggccgactcgctttattcagattcatttggaaatggaagataatctgccgctcgttcaggcgcattttgtggctgaccaggtagagcaggcgattttacagcgttttccgggttcagatgtcattattcatcaggatccctgttcagtcgttcccagggaaggcaggaagttcgagcttgtataattgattgttaaaaagtgagccaggccagcattttgtgtataaattaccgccatttggcctgacctgaatcaattcagcaggaagggattgttatactatctgtatattcgttggatcgtttcgaagtgcgaaatcggcttccggcaatagatttcattttgcattccaaagttcagaggtagtcatgattaagaaaatcggtgtgttgacaagcggcggtgatgcgccgggcatgaacgcggcaatccgcggtgttgtgcgcgcagcgttgacggaagggctggaagtcatgggcatttatgacggctatctgggcctgtatgaagatcgtatggttcagcttgaccgttacagcgtatctgacatgatcaaccgtggcggtactttcctcggttctgcccgtttcccggaattccgtgacgaaaatattcgcgctgtcgcgatcgaaaacctgaaaaaacgcggtatcgatgcgctggtagttattggcggcgacggttcttatatgggtgcaaaacgtctgactgaaatgggcttcccgtgcatcggtctgccaggcactatcgataacgacatcaaaggcaccgactacactatcggctacttcactgctctcggcactgtagtggaagcgattgaccgtctgcgtgacacctcctcttctcaccagcgtatctctatcgttgaggtgatgggccgttattgcggcgacctgacgttggcggcggctattgctggcggctgtgagtttatcgtggtgccggaagttgaatttaatcgcgaggatctggtggcggaaatcaaagccgggatcgcgaaagggaaaaaacacgctatcgtcgctatcaccgaacatatgtgtgatgttgacgagctggcgcactttattgaaaaagaaacgggccgtgaaacgcgtgcgacggtgctcggccacattcagcgcggtggttccccggtaccttacgatcgcattctggcttcccgtatgggcgcgtatgctattgacctgctgctggaaggccatggcggtcgttgtgtcggtatccagaacgagcagcttgttcatcatgacatcatcgatgcgattgaaaacatgaagcgtccgttcaaaagcgactggatggagtgcgcgaaaaaactgtactgattgtttttgcgcgcctgatggcgctacgcttatcaggcctacaggttgcagaaacgtgtaggccggattaggcgttagccgccatccggcaatccctcagatttattcctcgaagttatagccaatctttttttattctttaatgtttggatctctttctggcacgctttgctcatcacaacacaacataagcgagtctggcgatgaaaaagtggggcgtgggattcacattattgctggcgtcaaccagcattctggcaaaggatattcagttacttaacgtatcgtacgatccaacgcgtgagctgtacgagcagtacaacaaagcgtttagcgcgcactggaagcaggaaaccggcgacaacgtcgtgatccgccaatcgcacggcggttcgggtaaacaggcgacttccgttattaacggcattgaagccgatgtcgtgacgctggcgctggcttacgatgtggacgctattgcggaacgtggtcgtatcgataaaaactggattaagcgtctgccggataactcagcaccttacacctccaccatcgttttcctggtccgtaaaggcaatccaaaacaaattcatgactggaacgatctgattaaacccggtgtgtcggtgattacgccaaacccgaaaagctctggcggcgcacgctggaactatctggcggcatggggctacgccctgcaccacaacaataacgatcaggccaaagcgcaggactttgtcaaagccctgtttaaaaacgttgaagtgctggactccggcgcgcgcggctcaaccaatactttcgttgaacgcggtatcggtgatgtgctgattgcctgggaaaacgaagcgctactggcgacgaatgaactgggtaaagataaattcgagatagtgaccccgagtgaatctattctcgcagagccgaccgtttccgtggtcgacaaagtggtggaaaagaaagacaccaaagcggtagcggaagcctacctgaagtatctctactcgccggaagggcaggagatagcagcgaaaaacttctaccgtccgcgcgatgctgacgtggcgaaaaaatacgacgatgcgtttccgaagctgaagctgttcaccattgacgaggtgtttggcggctgggcgaaggcgcaaaaagatcacttcgctaatggcggtacgttcgaccaaatcagcaaacgctaaaccgtttataaacccggtaacgtattatgttaccgggttttttctttgccacaattttgcgttactcttccccgtctatgggtcacagggaacgcatatcatgaaaaaaacaggctactttttactggcggtgatagtgattgtcgccgcggcgggcgtcggttactggaaattttccggcaaccctgatgcattacgggaaatcgtgcttgaacaatgcctgcccgatcagttacagcatcaaaacccagcgccgtgcgcggaagtcaaacctcgcgctggctatgtcgtctttaaagatcgtcacggtccgttgcaatatttattgatgcccacctaccgtatcaacggtacagaaagcccgctattgctggaacccgctacgcccaactttttctggctggcttggcaggctcgcggctatatgagtaaaaaatacgggcatgatattccggatagcgcggtctcgctggcgattaattcgcggcttggtcgttcacaggaccatttgcatatccatatttcttgcatccgtcctgacgttcgggaacaactggataacgatctcacgcgcatcagcactcgctggcttccgctgccgggtggcctgatggggcatgaatacctggcgcgccgggtaaccgagagcgaactggcgcagcgtagtccgtttatgatgctggcggaagaggtgccggaagcgcgcgatcatatgggacgctatgcgctggcggtggtacgccaaagcgacgactcttttgttctgctggcgaccgagcgtaatttactgaccttcaatcgcgcatcggcggaagagattcaggatcatagttgcgccattttgtcttcccgctgattttcgttacaccccctgttcattatcttattgattcttatcccggtttaaaaccggggtaagatcgtgtctataaaaatatgtgaaatcgatcaaaagatataaaggtatacctttatatcttttgatggttagttacactctcttcatagcctccatagattgtctggtggatggcttatataaaaacgtttttatttcatgtagtgacatcattaattgttcaccagatttgcgctgttaagcgtaaaggaatatcaacatgaaactttctatcgtggaaaaaatcggcttcggcgcgggagatatggcgataaacgttgtgattatcgccatgcagctgctcctcgcctatttctataccgatatctacggcctgagcgccgctgatgttggcgtactgtttgtggttgtgcggatgattgatgccattatcgatccggccatgggggttctgaccgataaactgaatacgcgctggggacgttaccgcccgtggctgctgtggtttgccattccttttggtttcgccgtgtatttgatgtttattacgcctgacatggcttatatggccaagctggcgtgggcctatggcacctatattcttatgaccctggtctataccgcgatcaccattccctatatttcgatgattggcgtgattaccagcgaccccgtcgaacggttaagcgccaacggttatcgctttgtgatgaccaagattgccgcttttctggtgactatcgtcgtaccgatgcttgccgtctggctggggcagggcaacaaggcgctgggttaccagttttcgatggggctgatgggggcgatgggcgccttgctgtttatcttctgttttcttaccacgcgtgaacgcagcgagccggaaattacgtcgttatcggtggggaaacagtttaaatatctgttacgcaacgatcagtggattattctcggcgttgttattctgctgctgatgtgcggttatgttattcgcggttccgttgccgcttattacgctaagtattatctgaacggcggcgatagcctgatttcacccttcctgactaccggcgtcgttgcctctattttagcgatgatcgctaccacctggataaccaagttctgggacaaaattaagatgttccgctacacccagattattacctttatcctgagcgcgctgatgtatttctccgtcgggcgtgaaaaccttgtcctggcgtttgccttctattttcttattaatttcttctgcgatatgcaaatgccggtgttctggtcctctatcgccgaagcggtggattacggagaaaagaaaaccggtctgcgcgtttccgggttggcgtttggcggcatcctcttcttccagaagtttgggatggggatcgcgggcgggatactcggattcctgctgagccactttggctatcaggccgatgttgaacagagcgcgcgttcgctcaccggtattgcgctgatgatgacgctcattccggctctgtttcaccttgcggttgggctgcttatgaaaaagtatctgattaataatgaatattatcgagatattcagcttgccctggcgcagaaacaggcataaggaggcgcaaatgaaggccatgaataaggtttgggttatcggcgatgcctccgttgatctggtgccggaaaaacagaacagctatctgaaatgccccggcggagcgtcggcgaacgtgggggtatgcgttgccaggctgggcggagagtgcggttttattggctgtcttggtgacgatgacgccggccgcttcctgcgccaggtttttcaggataacggcgtggatgtcacgtttctaaggctggatgcggacctgaccagcgcggtgctgatcgtcaacctgacggctgatggggagcgcagctttacctatctggtgcatccgggggctgatacctacgtttcgccgcaggacctgccgccgttcaggcagtacgaatggttttacttcagctcaattggcctcaccgacaggcccgctcgcgaggcgtgccttgagggagcgagacgcatgcgagaagccggtggctacgtgttattcgacgtcaacttacgcagcaaaatgtgggggaatactgatgaaatccctgaactgatcgcccggtccgccgcactggcttctatctgcaaagtctcggcagatgagctgtgccagctcagcggggccagtcactggcaggatgcgcgttattacctgcgcgatcttgggtgtgacaccacgatcatttcgctgggggccgatggcgcgctgttgattaccgccgagggggagttccattttcccgcaccacgcgtcgatgttgtcgataccacgggagccggtgatgcttttgtcggcggactgttgttcaccctttcccgcgcaaattgctgggatcatgccctgctggcggaagccatcagcaatgccaatgcctgcggcgctatggcggtgacggcaaaaggcgcaatgaccgctttaccgtttcctgaccaactcaacacttttctttccagccattcgctggcacaagccatgaccgtgaaataaggagtcatcatgcacgttgatcgaaacaaaatactgggatgcctggtgggcgccgccgccgcggacgcgatgggagccgcgacggaagtacgcacccagcagcaaataaaagactattttggcggctgggtgacgacctttcaaaaaccgccagcggacacgtttggccgctgcaacgaagcggggatgtgcacggatgattttattcaggcgaagtacatcatggatgcgctgctgcgccatcaacgccaggtcagcgacgaggcgatgcgcgaggctttccagcagtggctggattacccgtactacgccaactttaccggcccgacgacgcgtgcggcaatgaaggcaatattcaatgataaccgcgcctctttacagggtgagctggaaggcgagaaacagtcggtacagattattaataagggtaacgcggaggcaacgaacggcgccgccatgaagatttggccagcggcggtgctgcacccgggtgatattgacgcggcgattgaatgcgcgctacagatttgccgctttacccataataacgtgctggcgatgtccggcgcagcggcgatggcggcggcaaccagcgaggcgttaagagcgcagaccaatgcagacagcattattgccgccggtatttacggtgcgcaaaggggctatctgctggcgcaggagcaaggggcgatgatggtcgccgggccttccgttgcccgacgcattgagctggccgtagatatcggtaaacgtcatcgccattgggaaacggcggtggtggaacttgctgatattattggctccgggctgcacgtgagtgaagcggtgccggcggcctttggcctgttcgcgtgttgtccgaattctgccgtagatgctattatctccggcgttaatatcggcaatgatactgatactgtcgccaccatggtcggggcgatttccggcgcattccatggcgtggaggcttttcccgccgattatttaacgactttggatcgtatgaatcatttcgatttggcagaactggccaggcaaatcgcagggtagcgacttcaccctgccggggacggtaaaacgtcccctgctggcgaagacgtgaggtgcgcagcttgcaggttgataaaacgagctttactccgctttataagcaactattttttatcatctgtcagcagatccagaacgggtctttgcctttgggtagccaactaccgacgcaaaaagagattgccagatcctacaacgtctcgctgattgtggttaaacaggcctggagcgaattaatcaatgcgggcattatttcctcccagcgcggaagtggttcggtggtgtgctcggtgccggaaggcgtgagctacgggcacacgtttcgcggtattacccgcgatctccaggacgccagcgtggcgattgagaaccgtattctggaaatcgcgccgcgccgcgcgcgcgacgctcaggcagacggcttgagcctgcccgcacagcatcactatctctatatttcgcgtattcgttgcctgaataaccgcccatttaaccatgagaaaatatatctcgatctcagcttctttcccggcctggaactcacaccgcaggcgctggagcatacgtcgctttattcgttattaaacgtcacaagcgactcggcgatagaaaaagttgaggcgattttaccttccgctgacctgtgcgaaaaattgcaaatcgccgccaataaaccgctgttatccgtcgccagacagacgtttcaggccgggaaggacagcccttttgagtattgccgctattacgtgctgtctgaatactttggtgaaattcattatcactgatctgtccacttaatcctgcgataaccccaccatatctggcgtttacctgcctgactgtccgtcgtattcttgctgaaaaaatcgtcaggagacaggtatgtcgctctggttgtcccatcctctgttcctcccgtccatcatcgttggcgttactatccttctgtgggcgacttcgccactgccggagtttatgaccgcactgctattttttgctgtggcgatgggaccagggaaagttcctgcgcgggcggggatgctgtgatgtatcgcgctggcggtgatacgccaaagcgatggctcttttgtcctgctggcgaccgagcgtaatttactgatcttcaatcgcgcttctgccgaggaaattcaggatcatcagtgtgatatcttgaaccaacaggtcatcaaatgacagcttgatattgcattaacgaataccgtttggaggccggacaaggctctcgtggcgctatccggcaaaatctggcgatggcgcgggcgttaccaggccggtggatctgcggggtggctgtcattttccagatgcggcgatttaataaacacgcctttccagggtttatcgccgttattaatgagataatgcgcctccccaggttcgcactgtaaaacatctccagtttgcaggatatgaggtgttccttccagatacaggcacacttcaccgcttagggtataaaaaatctcacaagcggtattatggcgatggttagggaatgactgccctggttgtagtatgacgacgcccatatcgcagcccggcccacggattaagtatttagggccattatcgccaaagcggtattcatgattcttctcattcgttttttgcatgcttattctcctgttacaggcctggcgctttccagagggatgtcgttaagccaccatcgaccagcgcgcgttgatcctgataaacggcctgccatttttctctggcctgctgatagacagcgaaattttcaggattaggtttatgctcccgatcccagcgcactagcttttctcccgtttccgccagcgatggccagacacccacgccaacgcctgcggcaatagcgcaccctagcgcggtagcttctttgacgacaggtacgtgaacggtgagtcccgtaacgtcggcaaggatttggctccataatttgcctttagatcctccgccagcaaaaaccagcgagtcggcctgtacgccggaaaacgcggcaatttgctgtaaattgcaggcggaaacaatggcggcattctcttccagcgcgcgaaatagggtcgctttattacacttttcaggatcgatagacagattgataaacgacggcgcggcatggtaccagcgtttaaaacgcataacgtcagagaagatgggcatcacaccgtacgcgccgggaggcacccggctggccatatcttccagcagggaatacgcatcaatacctaacctttcagcgattagtttttcctcggcgcaaaaggcgtcgcggaaccaacgcatcgttaacccagtaaaaaagctaatagactcggtttgtaccataccggggatcacatgaggattgatgcgaacgttcatgtttgggtcggtgaccggcgcgggaagattgacgacctgttgccagaaggttccgcccagcacggccgtttgcgccgggcgtacgacgcccagccccagacagcctaactgcacatcgccgccgccaacgatgaccggcgtacccgcttgcaggtcgcactgttcagccgctttctgtgaaatgtgaccgagcagcgtcccggtttcttttaccggcgagagaatgtcagaacgcaggcccgccatctgtaacagactacgtttccagttgcgggtcaccagatccaataaccccgtcgtgcctgcgttggagggatcgaccgccagttcgccgctgagcataaaggccatccagtcgctgatcatagtgacggttgacgcgcgatgataaatatccggacgatggtgggcaagccagagcagacgcggaatagcgctgagcgccagcgtttgcccggagcaacgataaacttcctcctcaaaggtgttatcgtacagctcttttaattcactgacttcgtgcgccgcgcgggcgtcaacattagcgcaggcccaaattggttcgccgttactgtcataaataacaatgccttcacgcatcgagcaggccgatacggcagcgatagccgttgcagggatggcggctttctgtagtgcctgacggatacactggcaagccagttgccagtttttggcaagatcaaactccatcgaaccaggcacatccggcacggccagatgctgccattccgcttgaccgacagctatttgctttccttgtagatcaaaaattactgctctgacgctaccggtaccggcgtcaagagccatcaggtaatgtcctgattcagtatgggtacagagtcgagccatttttttatcctcggctatttttacatcgttacataaaatcctgtcagttattgtttattgaattgaggtaagtgttattttatttttttatttttcaataatttgaattattttccctgcggttttctgatcggtaaccagtgcattgatatagttaccgcgcatagcggcaataatagcttctgctttttgttcgccgccggcgacgccaatcacggttgggatcgtggaaagtgaatttaacttcaggccaattaattcgttatggattttgatgtctggaataatttcgccatgagcatcaaaaaaatagcccagaatatcgcctactgcgcctttgcggccaatcatgagttgttcaccctgagtgatataaccggattttaagatactggcttgatctttctggttaattgccccaatccccacgatggcggcatcggcagcttgcgctgtgagcatcacatcccgcacgctattttcattgcgcagcgtgcaggcaatttcctgcgatgatgcgcgcagcggcgcgggcataatacttacgctacaagcggcatcaagctggcctattccggtcatatacggccccacgccgccggataacgtgaccagtcggatttgttgcgccgagataaatccgctgaggcgttttaatgtggtcatcgtggcttcgccaaagccgacggccagcagttgctgtggccgcagtgactccatcaacatatgggcggcgccgattcctaagcgcagaccaatatcggcatcgggtaatgccggcagcacgcggatattctgcaatgcgaagtggttgcgcaaggcattttcatactcaagacacccttcgaagcgggagttgatttgtacgcgaataataccggactgatgccctttctccagcagacgagaaacctttagccgggttagccccagacgctcgctgatttcactctgcgtcaatccatcgtgatagtagaaccaggcaatacgcgccacctgctcttcttcgcacattccataatcagataccaacgtattatcgctcattgtcataacctggctttactttgaacatttctaaatcattaacacaattgttcagttatcactccgaaataaccgtgattaacgccacaaaaacgcgccaaatctgaacatttatcatctaaaaattcatttattcagaaaacgtgatctggatgagagttttttgaccaaataactactaccgttttgaacaatttctttttcaaaaaacatttgttcagtcccgtcagtcaacattgagggagcggaggcaacatgcaaatcagtcacaatactgcatcccctctgatttgtgtgcagaacatttataaaagttattccggcgtcgaagtactaaagggaattgactttactctgcatgcgggagaggtgcacgcattgcttggcggcaatggtgcgggtaaatcaacattaatgaagattattgccggtatagtcccgccagatggagggactatcgatattgctggtgtgcgttgcagtcatttaacgcctctgaaggcgcaccagtatggcatttacctggttccccaggagcctctgttatttccgagtttatctgtgcgggaaaatatcttgtttggcttgcagggacgtcaggcctccacggaaaaaatgcagcagctattaaaggcgatgggatgccaactcgatccggcgagcgctgcgggtacgcttgatgttgcagaccgccagatcgttgaaattatgcgcggcttgatgcgcgactcgcgaatcttaattcttgatgagcccacggcgtcgttaacgccagccgaaactgatcggttatttacgcgtctgcaagagttgctgaaaaagggtgtcggaattgtatttatttctcataagctaccagaaattagacagttagctcactgcgttagcgtgatgcgtgacggtaaaatcgcattattcggaaaaacgcatgacctttctaccgacgagattattcaagctatcaccccggcaacgcagggcgtcagtctttccgcgaatcaaaagttgtggctggaattgcctggcagccgcccgcagaacgaacgcggcgcgacagtattagcgctggagtcactgacgggcgaaggttttatgaatatcaaccttgaggtgcgggcaggcgaaatccttggtctggccgggttggtcggcgcgggacgcacagaactggctgaaacgctgtacggtattagaccggtcaatgcggggcggatgctgttcaatggtcaagaaattaacgccctgacaacccaacagcggttgcagctcggcctggtctatttgccggaagatcggcagtcatccgggctgtatcttgacgcttccctggcatggaatgtctgttcgctgacccacaaccaaaaaggattttggataaagccccagcgggataacgccacccttgaacgttaccaccgcgcgttaaatatcaaactcaataatgccgaacaggcggcgcgtactttatccggcggtaaccagcaaaaagtattgattgccaaatgcctggaggcctctccgcaattactgattgtcgatgaaccgacccgcggtgtcgatgtctccgcccgcagcgatatttatcagctgttgcgcagtatcgcgcaacaaaatgtcgcggtgctatttatttcctccgatctggaagagatagagcagatggccgatcgcgtatatgtcatgcaccagggggaactgggggggcctgcgttatgcggcgaggaaattaacgttgataccatcatgcacgttgcgtttggcgaacatggtgcgtcggaggcaacatgttgaaattcatccaaaataaccgggaagcgacggcactgctggcaatagtctgtttattcgtgtttcctggcgcgctggatagtcagtatttgagcgtgcaaacgctgacaatggttttcagtagcgcgcaaattttgatgctgttggcgattggcgcgacgatggtaatgctcacccgcaatattgatgtatcggtgggctcgacgacaggaatgtgcgcggtattgctgggagtgatgttaaacgccggctatagcctgccggtcgcctgcctggccacactaatattaggaattgtcgccggattttttaatggcgtactggttgcctggttgaagatacccgccattgtcgccactctgggaacgctgggcttgtatcgtgggatcatgctgctatggacaggggggaaatggattgaaggattacccgcaggcttaaagcaactctctgctccggtgtttctgggaatttccgcaatcggctggtttaccctggtgttagcgctgcttatggcctggctcctggcgaaaaccgcctttggccgcaatttttacgccaccggcgataacctgcagggcgcccggcaattgggtgtccgtaccgagatggtacgcatcatggcattttcacttaatggcggtatggcggcattggctggaatcgtgtttgcctcgcagattggcttcattcccaatcaaaccggcacggggctggaaatgaaagccatcgcggcctgcgtattggggggaattagcctgttaggcgggtcaggcacggtcatcggcgctattctcggcgcttattttcttacgcaaatcgatagtgtgttagtgctgctgcgtatccccgcctggtggaacgattttattgctggcctggtattgttgggcgtactggtattcgatgggcggctgcgttgcgcattacaacgcaatctgcgccgccagaaatatgcccgttttatatcaccacccactccactacagacggaagcaaaaacgcacgcacaacagaataaaaacaaagaggtggcatgatgaatccatggcgacgctatagctgggaaattgcgctggcagccttattgatctttgaaattctggctttcggtctgattaatccacgtttattagatattaatgtcttactttttagcactagcgattttatttgtatcggtattgtcgctttgccgctaacaatggttattgtcagcggtggtatggatatttcatttggttctacaatcgggctatgcgcgattaccctgggtgtgctgtttcagctcggtatgccgctacctttagcgattattattaccctactacttggcgcaatatgtgggctgataaatgccggacttattatttataccggcgtaaacccgttggtgattaccctgggaaccatgtatttatttggtggtagcgcattattgttatctggtatggctggcgccacgggttatgaaggtattggtggatttcccacagcgttcactgactttgccaatatttcatttcttggtattcccatgccgcttattttttttcttgtgtgctgtctgtttttctggctgctcatgcatcgtacgcatatgggacgcaacgttttcctgattggccagagcgcccgtgtcgcgcagtacagcgcgatcccggtgaatcgcacgttgtataccgtgtatgccatgaccggatgcgcctccgcgatcgccgccgtattactggtttcttactttggctccgcacgttcggatctgggcgcctctttcctgatgccggccattacggcggttgtgctgggaggcgccaatatttatggcggctccgggtcgattatggggtccgcgttggcggcgctgctggtgggatttttacagcaggggctacagatggccggagtgccgaatcaaatttccagcgcattgtccggtgcgcttctcattgttgttgtcgttggtcgttccgtcagtttgcatcgtcaccaaatccttgaatggtactcacgccgtcgcaatgcgcatcaggcatgatttccttttgaaatttatggagaaaaaaatggcaagacacagcattaaaatgatcgccttactcactgcgtttggtctggcatctgcggcaatgaccgtgcaggcggcagagcggattgcttttattcccaaactggttggcgtgggcttttttaccagcggcggcaatggcgcgcaggaagcgggaaaagcgctgggcattgacgtaacttacgatggccctacagagcccagcgtctcaggccaggttcaactggtgaataactttgtcaatcaggggtatgacgccattatcgtttctgccgtttcgcctgatggcctgtgcccggcgttgaagcgggcaatgcaaagaggcgtgaaaatattaacctgggattccgataccaagccggagtgccgttcttactatatcaatcaagggacgccaaaacagctcggcagcatgctggtagagatggccgctcatcaggtggacaaagagaaagcgaaagtcgctttcttctattccagcccaacggtgaccgaccagaaccagtgggtgaaagaagctaaagccaaaattagccaggaacatccggggtgggagatagtcactacccagtttggctataacgatgccacgaaatcgctccagacggcggaaggtatcatcaaagcgtatcccgatctggatgccatcatcgcgcctgacgctaacgctttacctgctgcggcacaggcggcggagaaccttaaacgcaataatctcgcgattgttggttttagtacgccgaatgtaatgcgcccttatgttcagcgcggcactgttaaagagtttggcctgtgggatgtcgtccaacagggaaaaatttccgtatatgtcgccaatgcgttgctgaaaaatatgccaatgaatgtcggtgattcactggatattcccggcatcggcaaagtcaccgtttcacctaatagtgagcagggatatcactatgaggcaaaaggtaacggcattgtgttattgccggagcgtgtcattttcaacaaagacaatatcgacaaatatgatttctgataactgttatgtatcgacggagtaaagaatggctgatttagatgatattaaagatggcaaagattttcacaccgataaaccacaaactaacactttgttcgcattaaaaggctgtggcgcgctggattggggaatgcagtccagactggcgaggatttttaatcccaagaccagaaaaacggtcatgctggcctttgaccatggatatttccaggggccgacaaccggacttgagcgtattgatatcaatattgcgccgctctttgaatatgctgatgtcttaatgtgtactcgcggcatattacgcagtgtggtacctccggcaatcaataaaccagtcgttttacgcgcgtccggggcgaattctattctcactgaattaagcaatgaggcggttgcggtggcgatggatgacgctgtgcggttgaatagctgtgctgctgccgcacaggtttatattggtagtgagcatgaacatcagtcgattaaaaatattattcaactgattgatgccgggttacgcgtcgggatgccaataatggcagtgaccggggtgggtaaagatatggctcgcgaccagcgttatttttcactggcaacgcgtatcgctgcggaaatgggggcgcaaattatcaaaacgtattatgtcgataaaggttttgagcgtattgcggcaggttgtccggtgccgattgtcatcgccggcggtaaaaaactgcctgaacgtgaagcattggaaatgtgctatcaggcgattgaccagggggcttctggcgtagatatggggcgtaatatattccagtcagaagatccggtagccatgattaaagcggtacatgctgtcgttcatcataacgaaacagcagagcgtgcttatgagctgtttttgagtgagaaaagttaaatgagatcgcttccccatcttttaccgatgcgaggagatggggatgactgttattttatttggaataatcagggggttaatgatgcacgttacgctggttgaaattaacgttcatgatgacaaggttgaacaatttatcgatgtttttcggcagaatcatctgggctcaattaaagagccgggtaacttgcgttttgatgttctgcaggatccgcaggtgcttacgcgattttatatttatgaagcctacgttgatgaacaggccgtcgcttttcacaagacaacgccacactacaaaacttgcgtggagcagcttgaaccgttgatgaccggtccgcggacaaaaaaagtttttatgggtttgatgccttaaggagcgctcatgaacagccagtttgccggattaacgcgcgaagcatgtgtggcattgttagcgtcatatccgcttagtgtgggtattctggcagggcagtggattgcgttgcatcgctatctgcaacagttggaagcgctaaaccagccgctgttgcatttggatttgatggatggtcaattttgcccgcagtttaccgttgggccatgggcagttgggcaactgccgcaaacctttatcaaagatgttcatttgatggtagcggatcaatggacggcggcgcaagcctgcgtgaaggcgggcgcacactgcatcacgcttcaggctgaaggcgatattcatctgcatcatacgctaagctggcttggtcagcagaccgtgcccgttattggcggtgaaatgccggtgatccgggggattagtttatgcccggcaacgcctctggatgtcattatccccattctgagcgacgttgaggttattcaactactggcagtaaaccctggatacggcagtaaaatgcgctccagtgatttgcacgagcgcgtggcgcagcttctctgtctacttggtgataaacgcgaaggtaaaattatcgttattgatgggtcgttaacgcaggatcagttgccttcgctgattgcacagggcatcgatcgtgttgtttctggtagtgcgttatttcgtgatgatcggctggttgagaatacgcggagctggagggcgatgtttaaggttgccggggatactactttcttaccctccacagcataaatgccggatggcggctttaccttatcaggcctacataagcactcggctggtaggcctgataagcgcagcgccatcagacattgattggcaattaagcctgtttagcagcttctgctgctttcacgatcaccgcgaaggcgtcagctttcagagaagcgccgcctaccagtgcgccgtcgatgtccggctgcgcgaacagttcggcggcgttggaggcattaacagaaccgccgtactggataataacctgttcagcgattttcgcgtcagctttagcaatgtggtcacggatgaatttgtgcactgcctgcgcctgcgcaggagttgcagatttaccggtaccgatcgcccatacgggttcgtaagcgataaccgcgccttcaaaggctgccgcgccctgcgttttcagtaccgcgtcgatctggcgtgcgcatacttcttctgttttgcccgcttcgttttccgcttcggtttcaccgatgcacagtaccggcgtcagaccttgttctttcagtacggcgaattttttggcgatcagctcgtcagattctttgtgataagtacgacgctcggagtggccgataataatgtactgcgcgccgatatccttcagcatttcagccgaagtttcaccggtgaatgcgccagacagattcagatcaacgttctgcgcgcccagcatgatgtggctgccggcagcagcgcgtttcgccagatcgatatacatttccggcggagcgattgccacgtcgcagcctgctacgcccgtcagttctttacgcaggttagccaccagttcgtttaccatgtggcggctgccgttcagtttccagttacccatcactaaaggatgtcgcatttcatttctccacgcttagtcagcgaattaaggaagatggccgctcgtcagagcagcatggtctgtgaaacagtatagagattcatccccggaaaggctttgctttttgtcatcaattcgccccttccagattttcagataacgtcagcttaatcggttcaaccgcgaaggtcagccccttttcgccgttatctgcgacaacataacgtaccgcgccttcggtctcggcgtaatagtgtttacctttaccggcgataagcatcttttgcagttttttctggctttgctcttttgtcagtaacggggcgacagtgcgaataatggcggccatatattccagcgctttcgctttcgccgctttctgttccggcccctgaatgggcagccaggtaatctgcatacttttcactttgagcgtaccgcgctccagcgccgtggaggcatacagattttcgttaatcttactggcggcgcgggtcagattcgccttatcgcggctattctcaatggcgcgaaattcattgagcggcagatcgggattctggcggttaaagttctcacgaaactggctaatagaaagatcaaaggttggcgagcccgccagcagatagggcgctgtcgtggtcgatgaagagagctgcgcgtgcgccgttatgctggcggtgagagcagaaaacaacagtaaaaacagagtacatcctggcttcatcaatcttacctttcgttaggactgctcacgattaaaacgataactgtcgggcttgtcaaaagggtaaactgtagcggaaggcaaaatataaggaacttacatgaccatacagcaatggttattctcatttaaagggcgtatcggacgccgtgatttctggatttggatcggcctctggtttgccgggatgctggcgctattttcgctggcggggaaaaacctgcttgatatccaaacggcggcattttgcctggtgtgcctgctgtggccgaccgccgccgtcatggtcaaacgtctgcatgaccggggacgttccggcgcgtgggcgttgctgatgattctggcgtggatgctgctggccggaaactgggtgatgctgccggggatgtggcagtgggtcgtcgggcgatttattccgacgctgatcctggtgatgatgcttatcgatctgggcgcgtttgtcggtgttcagggggaaaataagtttgggaaagcgacacaggacgtgaagtttaaagcagaaccgtaaacgggcggtaaaccgtaatttgcccggtggcgctgacgcttaccgggcctacagattggtgatgatttgcaggccggataagccccagccgccattcggtaaaacatcaccagtaatgttcagccgtcatatgccccggtcggcggcgcagatgtttagtcatctgtcgggtctctttcagcagttgctgcgtatcgcgcaccatctgcgggttcccgcacagcataacgtggctggtctctttatccatcggcaatccaacggctttttccagctcgccgttttcaatgagcgctggcacgcgtccagtaagcgagcctggcacgttctcccggctgaccaccgtttggatgcgcagcttgccttcataacgctgttgcagttccagcattagcggcagatagcttaaatcggcggcgaagcgtgcggcgtggactaagaccagatttttaaagcgtgcgacatcctggccatattgtagaatagacaaatacgggccaatagcggttccggtcgccagcatccatagcgtctcgcagtcaggcacttcatccagtacaaagaaacccgacgcgtcgctgaccacttgcacctcatcgccaggttttagcgccgccagccgcgggctgagctttccttgcggcaccgtcaccagataaaactctaaattcggattgtcaggcgcattgacataggaatacgcgcgctgaacgcgctcgccatcgatctccagtccgagtttggtaaattggcctgcagtaaaaggattaatgggggcgtgaacggtcaggctgaacagtgcgtcagtccagttttgcaccttagtgactttacctgttacccaatcggccatggttttctcctgttctgaatcgctaaccttatcttcgttcgtcaggagaaagatttccagccccgcgaggctggaaggctctaactaacaaatgcgctagagaatatgcgcctgcacatccggatctttacgatcaagatagtggatagactgaatgcggcggatggtgcgtgatttgccgcggatcagcagcgtttccgtcgtggcaatatggcctttccggctaattccttccagtagatcgcctttcgtgatgccggtcgcggagaaaataacgttatcgctacgcgccatgtcgcccaggcataacgccttgcccgcttcaatgcccattgctttgcagcgcgccagttcctgttcgccaatgcggcggttttcttcgctgttgcctttcacgtcatggcgcgccagcagacgcccctgcatatcgccgtccagcgcgcggatcaccgctgcggataccacgccttctggtgcgccgccaatcccgtacagcacgtcgacttcgctatccggcatacaggtcagaatggaggccgcgacgtcgccgtcaggaatggcaaacacgcgtacgcccagtttggccatctctgcgatgacctcgtcatgacgcggttttgccagaatggtcacggtcaaatcgccaagcggtttacccagcgcatccgcgatgttgcgcaggttatccgccagcggcagattgagatcaattgcccctttggcgcccggaccgacaatcagtttttccatatacatatcgggcgcattcaggaaacagcctttatcgccgaccgccagcaccgccagcgcgttcgcctgacccatcgccgtcatgcgcgtgccctcaatcggatcgacggcgatatctaccgcatcgccgtggccggtaccgactttctcgccgatatagagcatcggggcttcgtcgatttcgccttcgccaatcacgatggtgccgtcaatgttgacctggttgagcatgatacgcatggcgttgaccgccgcgccgtccgcggtatttttatcgccgcgtcccagccatttgtagccagccagcgccgccgcttcggtcacacgggaaaattcgatggcaagttctcgtctcataacaaactcgtagcaaaaaggagtggcgcgcagtgtagcacaggggaaggagggaataattgatgtgtgtgcggagttgcctccgcacaaagattttgccggatggcgaccttacttgtcgtgctcttcccacgccattgcgcgtttaaccgctttcttccagccgctgtaacggtagttacgctcggtggtttcaatgccggggcggaattctcgctcaatgacggctttttcctgcagctcgtccaggttctgccagtaaccgacggccaggccagccagataggcggcgcccagcgcggtcacttcgcgcacttccgggcgttccacccgcgtgccgagaatatctgactggaactgcatcaggaagttgttggccactgcgccgccgtccacacgcagagcgtgcaggcggataccggagtcggcctgcatcgcttccagtacgtcgcgggtctggtaagcgatggattcgagcgtcgcgcggataatgtgattagagttcacgccgcgggtcaggccaaaaatggcgccgcgggcatacgggtcccagtacggcgcgcccagaccggtgaaggccggaaccacgtagacaccgttggtatctttcactttcgtggcgaaatattcggagtcgaacgcgtcgctgatgagcttcatttcatcacgcagccattgaatggacgctcccgccataaacaccgcgccttccagcgcatagttgacttcgccgcttgggccgcaggcgatggtgatcagcaggccgttttccgattttaccgctttctcgccggtgttcatcagcataaagcagccggtgccgtaggtattctttgccattccttcctttacgcacagttgaccgaataacgcggcctgctgatccccggcaatcccggcgataggaatacgtgtaccgcctttaccgccaatattggtctggccgtagacttcggaggacttacgtacctggggcagcatcgcgcgtgggatatccagcacgtccagcatcttatcgtcccagtccaaatcatggatgttgaacagcatggttcgtgaggcgttggtgtaatccgtaacgtggacgcggccctgcgtcatcttccagataagccaggtatccaccgtaccgaacagcagctcgccacgcttcgcgcgttcgcgcgaaccttccacatggtcaaggatccatttcactttagtgccagagaagtacgggtcgacgaccagaccggtattgtcgcggatgtaatcttccaggccgtcgcgtttaagctgttcgcaaatatcggcggtacgacggcactgccagacaatagcgttgtatatcggtttgccggtttcacgttcccagacgatcgcggtttcacgttggttggtgataccgatagcggcaatctgatcggaactgatatcggccttagccagcacttctaccagcgttgagctttgggacgcccaaatttccatcgggtcgtgttctacccagcctggcttaggataaatttgctcaaattcacgctgtgatacgctgacgatattcgcgtcatgatccataacgaccgcgcgggagctggtggtaccctggtcgagcgcaacgatatattttttttcagtcataattttgtcccgtaatcagattacagcgaagcattttgttgtgtggtcgcggtggagtccttctcttccacgacgcaggtatcgcacggcaaatgacggccaataaatttgcgataagcaaacgcgcccagaatggcgccgacgatggggccaaacagcggcaccaggaagtaaggaatgtctctaccgccggtaaacgcaatttcaccccagccggcaagcccggcgaacattttggggccaaagtcacgcgccggattcatcgcaaacccggtcaacggccccatagaggcaccgataacggcgatcagtaaaccaatgagcagtggcgcaagcggaccgcgaggtacgccgtttccgtcgtcggtcagcgccagaatcagccccatcagaatagcggtaatcaccatttcaaccgcgaaggcctgcacaaaattgatatgaggattcgggtaagttgagaaaatgcctgcgagatcgagactttcaacgctgccacggacgatatggtgggtttgttcgaagtccacaaaaagattgtaataaagcccgtaaactaacgccgctgcgcaaaaggcgccggcaacttgagaaataataaaaggaacaactttacgtttgtcgaaacaggcaaatagccagagtgcgatggtcactgccgggttcaggtgtgcgccagaaacacctgccgtcaggtagatagccatcgctacccccagaccccagatgacgctgatttcccactgtccaaaagtagctccggcaactttaagcgcagcgacacaacccacaccgaaaaaaatcaacaacccggtaccgaggaattcagcaatgcactggccttttaaggttgatgtttgactcataatcggatcctgaagagtatgtaatgattattggtatgcgaggaggtcatggacatccacgatgccctgtaggcacactgttaatttatcgttaacgagcaaaaacgagaaatatcgaaatcaaaatgtgtgtactgcgtcaataaaatgagcgttatcgcgccatgaagcgcattttgagacagcagaagagagtgaattgaatcatttcattaaccaatatgttaacacttttaagttattgaatgaatgttaccaggagatggatgaaaattgctgcaaaccgcgatctacgcggtatgtcgctggacagcgagagcggggcttcatacaatcgacactatatattgtgcgcgtttacgtgaagcgtcgccttgcaattcaggagaggtaagatcatgtctttagaagtgtttgagaaactggaagcaaaagtacagcaggcgattgacaccatcaccctgttacagatggaaattgaagagctgaaagaaaagaacaacagcctgacgcaggaagtgcagtctgcacagcatcagcgtgaagaactcgagcgtgaaaataattctctgaaggaacagcagagcggctggcaggaacgtttgcaggcgctgcttggtcgtatggaagaagtctaatcctcgtcatatttcacgttatggcggcgttggctgcgtgcgttcaccccagtcacatagtggcctatgctcctggggattcacttacttgccgccttgccctgacgcgaaatctatagaggatttagaatgcggataccggtgggccggataaggcgtaagctgccatccggcaatcagcgacaacgcataaaaaaggcgccttacggcgccttttttgatcactcgatatcaagcgggtcttcggaaaggataatcccggtgttgtcggcatagagatgatcgccggagaagaacgtcacgccgccgaaattgacgcgcacatcgctttccccaatgccttcacctgcggcgccaaccggaatggcggcgatcgcctgaatgccgatatccagctcttccagatcgtccacctgacgcaccgcgccatagataaccagcccttcccattcattttgcgtggccagacgcgccagctccgcatcgactaatgcacgacggacagaaccgccgccatcgaccagcagaacccgaccacggccattttgttcgagcagatcgtacagcaacccgttgtcctcgaaacattttaccgtgatgatttgtccgccaaacgacgaccgccctccaaaattagagaacagcggttccacgacgttgacatcttcctgatagatgtcacaaagctcggaagtatcgtatttcataggcttaacgttcagttgctgcgagaatttttagtatatcgcgctaagtatactgttggcaaaatcatcaattgttaattgatatttgtcagttaaacggcccactgacttaagagtatcccaatcacaaataacaggttggttaacaacgcgcctttaacggtacgttcaagcatcgggcgcattgccgcaggctccctttcgcgcattacgtagcgcgcttgtttaatgagcaagggcgcggccagaataaacaaccatccccacggactgtgtagcgagagcagattaaacagcgccagacagagcagcgcgcctagcaacaggcaggcgtgataacgacgcgcgttgacatcgcccagtcgtactacaagggtgtttttgccgttctctctgtcgctattaatatcgcgcaggttattaatattcagcaccgccgtcgccagtaaaccgcaggcggtggccgggagaatcagcgccggaatcagcgtatgcgcctggagataccagctccccatgacacttagccagccaaagaataccaggacagagatatcacccagcccgatatagccgtagggccgattacccacggtgtaggtgatggcggcgataatcgacagcccgcccaaaatcaggaagccgacaaaatcggttaacgtatggcacgcgaccgccaccagcgccagtccggagatacagatcagcacgacggtaatgattaacgcccgcttcatctcctgtcgggtgatgacgcctttttgcatcccccgcagcggcccgatgcgatccggtttatcgctgcctttgacagcgtcgccataatcgttggcgaggttggataaaatttgcaacagcccggcggtgataagggccagcagcgcgaccagaggatcgaaatagccttgccaccatgccagggccgtaccgacgataatcgccgcgaaggcgaggggtaaggttttgggtcgtaagctttccagccaggcctgggtgcggctaatttgttgttgttcagtcatatttagcgccaataaaaatggggcttttcagccccatcaacagtgatgaaaatgcattggacgcgattataagataaaacggcttagatcttcatctgcgaccagcgcatccagatgtttgctcacatattccgcatcaattgtgatgttttggccgtgcagatcgctggcgttataggaaatctcttccatcagacgctccagtacggtatgcagacggcgcgcgccgatgttttcggtggtttcgttaacctgccaggcggcttcggcaatacgtttaataccggaatcggtgaactcgatattgacgccttcagttgccatcagcgctttatactgcacggtgacggaggcgtttggctcggtcaaaatgcgttcgaaatcgctggtggtcagcgcctgaagttcaacgcgaatcggcagacggccctgcagttccgggatcagatcagacggcttcgccacctggaacgcgccagaggcgataaacagaatatgatccgttttgaccatcccgtgtttggtcgaaaccgtgcagccttctaccagcggcagtaagtcgcgctgtacgccttcgcgtgaaacatccgggccggaggtttcgccacgcttacaaattttgtcaatttcatcgataaacacgatgccgtgctgttcaaccgcgtcgatagcgtcctgtttcagctcttccgggttgaccagtttagcagcctcttcttcaaccaacagtttcatcgcgtctttaattttcagcttacgcggtttctgtttctgaccgcccaggttctggaacatagactgcaactggctggtcatctcttccatgcccggaggcgccataatctctacgcccatcggcgcggcggcgaggttaatctcgatctctttatcgtcgagctggccttcgcgcagttttttgcggaacgtttgacgggcggcagaaggctcctgctgctgttcggcctggccccagttattttttgcgggtgggatcagtacgtcgagaatacgttcttccgccaactcttccgcacgatagcggtttttctcgatagcctgtacgcgaaccattttcaccgcggcatcggtcagatcgcggatgatagagtccacttctttcccgacatagcccacttcggtgaatttggtggcttcgactttaatgaacggcgcgttggcgagttttgccagacgacgggcgatttcggttttaccgacgccggtcgggccaatcatcagaatatttttcggcgttacttcgtggcgcagctcttcatcaagctgcatacgacgccagcggttacgcaatgcaatcgccacggaacgctttgcgttatcctggccgataatgtgtttgttcagttcgctgacaatttcgcgtggggtcatttcagacatgagaggtccttacgctttggcggtcaattcttcaatggtgtggaaatggttggtgtaaatgcagatatcgcctgcaatatccaacgccttttcagcaatttcgcgcgcgccgagctcggtattttccaacagagcgcgagcggcagcctgggcataaggaccgccggagccgatagcaattaaatcgttttcaggttgcacgacatcgccgttacccgtgatgatgagcgaggcggtttcatccgcgacggccagcaacgcttccagtttgcgtagcatacggtcggtacgccagtctttcgccagttcaacggcggctttgaccaggtgcccctgatgcatttccagtttacgttcaaacagctcgaacagcgtgaatgcatccgcagtaccgcccgcaaagcccgcaatgaccttgtcgttgtagaggcggcggactttcttcacgttgcctttcattactgtgttacccagtgtggcctgaccatcaccggcgattaccacgtggccgttacggcgtacgcttactattgttgtcacgagcagaccccttggttactaatgctgaattgcggccccgtacggcgtacggggcataatgcaagtatagatgggggagattttgagggtttcaacccccggtggcgagtcgaatgcagtttgtatggcccgccatcttcagacggttaatggtgctgtcggcattttctttacctttcaccggcccgataaccacgcgattccagccgttattggtggtaattttggagtcaaagccttcaaacgccagctgagcgcggacgctttctgcctgctcggcgcctttgaatgaaccacattgcaccatccagcgacgttcatcttttttctctgctgtcgccttcggcgcttcaggcgcgcgcgtaatgggcgcggcttttggcgctgccgcgctggtatgcgccggcgtttgcagcaaatcctgataaggttgctgcgaggccgtctgcttcggcggctgactttggcgcgcgggttgcgccggggcggactgtaccgtgcgcgtttgcggctgttcgtttacccgcggctgcgtacgtggttgctgaacaggctgcgtttgagcccactgctgctgctgcgcctgacgctggcgctgtagcgtttgctggcgttgttctggcgtctgctcgttccacggcacttcgttaagttgcgtcggctgctgacgcatatccgcctgcatctgttccaggagttgacgctgctcgctggtgagctgattcggattcatgacttcgccgccggcggacggttccgttggcgtacgcacgcccggctggcgactttccagctctttgatgtaacgccagcgctcttccggttttggcggaagcccattgccggtgactttctggttttgtagcgtttcggactcttctttcttatggtgagtaatgaagtacagaccgccgataaaggtcacaaggacggctgccgcaatcgcgaccattgccggcgagacggcaggcatgttgctttgcttcttccgtgagttccgtgaggtgctctttttgcgccgcgaaggagccggttggccgcgacgtacataatctcgttgtgccactatcgtttcgctgtatttattcgttcgtcagcccgtcatgttactgaagcggcgggcctttgaccagacaggtgagtcttaaagctatttactttagggtaaagcgcgcgtagaaccgcgaataatcagctcgcaatccattaaacgcgagccgctgctcacattttgcccctgcatctgatcgagcaacaacagcatcgcctcgcgaccaatgtcaaaacgcggctgcgccacggttgtcaacggagggtcgcaaaactcggccagcgcgatattgtcaaagccgataatcgacagatcgtcaggcactttcagaccctggcgcttggcccaggagagggcgcccagcgccattacgtcgctatgacaaaagacggcggtaggcggcaacggttgctcaagcaactgctttaatgcgtttgccccggcttcaaaggtaaagtcgccacgggcgatgtaatgcggatcgaccacaatgccactgcgtcttaatgcctgtacgtaaccttgtaagcgatagtgacagagcggcatatcttccggccccgcaatacaaccaattcgcttgtggcccaaatccaacaggtagttcatggcattgaacgcggcggtgaggttatcaatatgtaccgtcggcagttcaagctccggcgcgaactcattcgacatcaccatcggaggcaaattgcgctgctcctcaacgctggcgtcaaagggcagtcgggaactgagaagtaccatgccgtcgatctgtttggtgatgatgagattaagaaaggttttttctttctggttttgatgggcgcaatcgccaatcagcaccagatacccctgttctgccgcggtcacttcgataccgcggataatttcactgaagaagggatcgcaaatatccgggacaatcaccaaaatcgtacgggattcattgcgttttacatttcgccccatcgactgcgggaaataacccacttcaagcgcggcctgttcaacccggctacgggtcgactgggagactttatcggggttcattaacgcgcgggatacggttgccgtagagactttcgccttcaacgcaacatccttcatcgtagcggcagtaacctgcttgttcgatttcactctttctcctcgcctgggaactgctggcgcagatctatccctggtaacactcatcgaaaacatttttatcagatagtgcgtggaagcggttacagaattttcataaaaagtgtgatggatctttaattttacgatccgcctcgcatcgtgaggactatccttcaatcggatcgacgtccagaacccatttaactttccgcgcttccgggagcgtattgatcaacgccagcgtgccgctgatgatgtgttgcaggcgaatccgtgaaggatgctgaagtaaaatttgccagcgatagcggccgccgcgttttggcgcgagggccggaaccggacctaagatccacagcttatcgtctgatagcgggctggcctgaatcagattacgcaactgttggagaaagacgggcgcctgctgattgttatgatcctctgcgcgaataatgacgtggctggtccacggcggaagctggagcgtttgccgttccgccagcgcctgctccgcaaacgcatcatagcctttatacagtaacgtttgcagcaggggatgctcaggatggtgcgtttggagcaccacttcgccctgtttgcccgcgcgcccggcgcggccggaaacctgagtgtagagctgggcgaagcgttccgccgaacgaaaatctgcggaaaaaagcgcgccatcgacatccagcaacgccaccagcgtgacatccggaaagtgatggcctttcgccagcatttgtgtgcctatcaggatgcgtgctccgccgcggtgaacttccgccagatgctgctccagcgcgcctttacgactggtggtatcacggtcgattcgtgagatcggcacgccggggaagaagggcgccagcacctgctccagctgttccgtccctaacccaaccggtaacatatgtgtggagccgcaggaggggcactgacgcggtaccggacgctggctgtcgcagtgatgacagcgtaaatgatgctgcgcctggtgcagcgtgtagtagtgatcgcaacgcgggcactctgcaatccagccgcagtcgtggcaaagcagcgcgggcgcgaatccccggcggttaagaaataaaattacctgattgtcggcctggagatgttggcgcatacgggcgataagggcgggcgccagtcccgcctgaagacgctggccttttaaatccagcacatgctgcagagctgggcgggcgttgcctgcgcgccgcgtcagacgcagcatccggtattttttctgccgcacgttacatagcgtttccagggctggggtggcggagccgagaataatcgggatctgctcgctatgggcgcgatacactgccaaatcgcgggcgtggtagcgccacccttcctgctgtttataagagctgtcgtgctcttcgtcgatgacaatcacgccaagatttttaaacggcgtaaacagcgaggaacgcgtgccgatgacaatcgccgcttcgccgtttttcgctttcagccatgccgaaagacgctcgctgtcgtttagcccggaatgcagcacttccaccggcgcgttaaaacgttcgcgaaaacgggcgatcgtttgcggcgtcaggccgatttccggcaccatcaccagcgcctgtttgccctgggcgaggacgttttccagcacgctcagatacacttcggtcttgccggaaccggttacgcctgccagcaaccaggcggagaaaccgtccgacgcgctgtgaatcgcgccgactgctgtcgcctgttcggtattcagccgcaggcgctctcctgcgacggcataacgctcccgccagtcggtaaacgcgggcgtttcactggcaagctcacaaagtcccttacgccgcagcgtttgcagcgtggcgtcagtaaaatcaagctcggctacctgatagcgccagatctttccttgccgtagcgccgccagcgcctgttgttgtttggcggagcgtttcaggctgttgatatcgacggcttgcccctcttcggtggcgaaccaataccataggggcgcgttgctggctggttttccctgacgcaataaaaccggcagagcgtgaaacagaacgtcgccgaggggatggtggtagtaatccgccgcccagaggagtaagcgccagatggagggagaaaagattggctcgttatccaggatttcaatgaccgattttaattcatcgagcggcaattcgctgtggtcgctaatcgagacgacaatgcccacgcgctcttgctgcttgccgaatggcacgcgcacgcggcacccggctttggcgaccccgccttccggcagcaggtaatcaaaggttcggggaagcggaacgggcaaggcaacgtgcgcgacggacatagcatcttcctgacttgaaatttcgtcgggtagtatacacattacgataagggagcgcggatcagtttgcatacggtggtcaaattctgtatgattcgccgcctttggtgcgtgttgtgagcatcaaaccctttactattaacttcgcgtggtgtctggcgttagggctggaagagcgacgcggccttacactgaggttccccatgaaaaaaggtattcacccgaattacgtagaaattactgcaacctgttcttgcggtaatgttatcaaaacccactctaccgtgggtcacgacctgaacctggacgtgtgcggcaaatgccacccgttcttcactggtaagcagcgtgttgttgataccggtggtcgtgttgagcgcttcaacaagcgcttcagcatccctggcagcaaataagttaccgccagaaaaaaaagcgccgcagggcgctttttttgttttctagggataacagtatttgttcagacacattctgtgatccgtaatcgctttcattacgcttcctgccgtgagttttaacgaaggatttatagtcagtcccgcactttccagccccttcgctgtccatttattgcaggtattgagtatgccgtagcggccattcgcggcgtaaaactggctatcgccgtaaattccttgttttaacggaatcagattacccccttcgtcacgcgcaaagctgcggcccagatagcgcatcagactgttacgctggtttgtgtgcaggagcagtgattttatctcgctaccgacgaaatagcgttctggttgaccggaaaaggcgacgatgtgcataaccgcgccggatgaccagaacatggcctggagcgtaagcgcggtggttatttcttgtgactgataaaagcccttatcgccccagccgatttcataccactgcgtctcctgagcgaaccgttttttaagctgtggcagaacggtattaacatcatgggccggcgcaataattcccgtgtgccagccatgactgacgatatagatttccgtcggggagggctgtccgcctgtcgtaggttttacggcttgtggaaaggttgtgcagccatatagcaataaacttatccaggcgataaagagatttttcatgacatatcaccagcaaaggcgcggtatattgtggcgtttgtctaatgacgctgcgcttatcgggtcggtgccggattggtaattcattgatatttttgcattcctcttcgagggcaataaggcgaatgtcataactacaatacgttttaaccattcaggcggaagttagcttccgcctgttttacttttactatctcgctttattttttaaacatctgctctggatcgataatcagcgcccgataacccagcataccggcacggttactgtgtacttttagctccagcatcacatcctgagtaccgtctttgacttcatccagaacggaaacgatcggttttgtaccgctcattcccgctgtggccgagtacatgaacatcgttttggtttccgggcgatattccgtgacggaagtaatggcgctgtaccagtcaaaaccgcgctctttaccatattcccacatttgggaaaccgtcatatttttttcgtcaatttgatattccacgccgcgggaatatttcattgatggcatggccggttgttccatgccgcgcgcatcgccgttatcaaaggcggtcacgacggttttacctccggtgcttttggatggcactaaccaaccggtatgttgtgtccatgtccagtcaaatccaccgtcgcagtggtgcgcttcgcaggttagcggtttaccgttgctgtctacgggtttcagcacttttttcgccagttcgcctttccagccggatggatcggaaagtatccatttcacttttttatcgcgaccaattttgatgatggcagactggtggcgcgagctaatgataatgctgtcgtcgcgaggatcgtagctgacggagttaacatgcgcccagttgcggcccgggccggagcccgcgatatcgccgaagggttgttttgcaagctgctctttggtcatgacctgaccggaatgttcggcatcgacgctcaaacataccgctccctgatccatcgccagaataacgtcgtcacgataggggtcgaggatttttggcagatcccagtaatcgacggtatcgccgttctggtcaacttcaagaatatgatcacgcacagtattgatggtgtatttaccatttaatggataattttcttttgcgacacgcagcaggtaggtgcctttcggcgtttcggtaatggcgtgcgaaaaatcaataaatccttttggcagtcgtttatcggaaataacgcggcctaagaaatcatatttaaagtaacgttgaccctggccaaacataagattgccatcgttaacctgatggaagcccatcatggaaccaaagcgcgttatatcatcctggttacggaatttatcaatattcatatagccgcgaacatcgccattcgtatcgctaatccagttgataccggtataatcccagttcgccgcgccgcctgcgacatgcataatgtggccggctcttggcatccccgttatatggttaaaaagatataagcggtttttaagcgagctatcgactttaaccggttctaccgtaggaagaacggcagtttgcccggtagtagagggtaatgataccggtgcggcgtaaatggaccacgtataagtttgttttttaccttcttcagtccagtcaactttaactttattgacataatctggatacaagccaaatacaggtatgccgtcatgggtatttatagcctgcgggccgacatcataactgatcgggatgcctttttcccctttccctaaaacggtaaccttcacgtcctgtacattatgattggctttattaatgattgctgttaatgggaaaacgccgccgtagggagcgacatcgaccatacctaatggcccttcatggactggaatgacatctgctgatgcgaccattggcctgtttgggtctaaaacgcctgaggccaaaacgctgccgctcaaacacaggcagcataatacaggtaagactttccttgtaaataacatatttatttccccattcgatattatcgataaaatgaatgtatattaaccttcttatttatcggagatgaaaaaacatttaaaaaagtaaaacaatccgcggaggggaataatgatgttggtcacaaatatgaggtgtccatagtctttttaacaatactcattgttatactatttgttcagtaaatatatggcgctgtattattattcatatgcgctttgctacgtgaaacattaaataaatattagaagtttaaatataataaaattatatcggttataacatgccgggaattttttccaggaaaataacgaagagaaacttatcatgtctgacaaatttatccaccgagggttattcgggaagatgaacatttagaacaatgtcggagatagccgtgtacaaggggaatcgttaaaaaagcgcggccagaggcgttctgaccgcatgctttgctatcagtattcccacgtttccggatcaatccccaactcacgcatgatctcttttgccgcttccgggatttcatcgctgcgctcttttcgcagatcggcatcatccggcaagggttgcccggtaaaggcgtgcagaaatgcttcacacaacagctcgctgttggtggcgtggcgcaggttgttcacctgacgacgcgtacgttcatcggtgaggatttttaacaccttcagaggaatggaaaccgtaatttttttgacttgctcactcttcttaccgtgctcagcgtatgggctgatatattcgccgctccattcagccatgagatacttaatcctcttcgtcattaatattgaggtctgaacctgagcccggaccataatcgcgcgtagtttaccgtagtggcgcggccctgacacgaagttagcggtcgcagatgtgcgctaatgcatataattttaacggctatttgcggtttgctcaatctatacgcaaagaagtttagatgtccagatgtattgacgtctattgtggtagtggttaatctgtggcctgactttcaccgactcagccaggaatatcttcatatgacgcgtaaacaggccactatcgcagtgcgtagcggattaaacgatgacgaacaatacggctgcgttgtgccgccaatccatctctccagtacctataactttaccggtttcaatgagccgcgcgcgcatgattattcccgccgcggtaatcccacgcgtgatgttgttcagcgcgcattagcggaactggaaggcggcgcgggcgcggtattgacgaataccggcatgtcggcgattcatctggtcaccaccgttttcctcaagccgggcgatctgctggtcgcgccgcatgattgctatggcggcagttatcgtctgtttgacagtctggcgacacgcggctgttatcgtgtgcggtttgtcgatcagggcgatgaacgcgccttacaggcggcgctggaagaaaaaccgaagctggtactggtagaaagtccaagtaatccattgttacgcgtggtggatattgcgaaaatctgtcggctggcgcgcgaggcgggcgcagtgagcgtcgttgataacacgtttttaagcccggcgctgcaaaatccgctggcgttgggtgccgatctggtgttgcattcatgcacgaaatatctcaacggtcattcggatgtcgtggccggcgtggtgattgctaaagatccggaagtggtcactgaactggcgtggtgggcgaataatattggcgtgaccggcggggcgtttgatagctatctgctgctgcgcggtttgcgaactctggtgccgcgtatggagctggcgcagcgcaacgcgcaggcgattgtgaaatatctgcaaacccagccgttggtgaaaaaactgtatcatccgtcgctgccggaaaatcaggggcatgaaattgccgcgcgccagcaaaaaggctttggcgcaatgttgagttttgaactggatggggatgaggagacgctgcgtcgttttctgggcgggctgtcgctgtttacgctggcggaatctttagggggagtggaaagtttgatctctcacgccgccaccatgacgcatgccggtatgtcgccgcaggcgcgtgcctccgccgggatctccgaaacgctactgcgtatctccaccggtattgaagatggcgaagatttaattgccgacctggaaaatggcttccgggctgcaaacaaggggtaaacatgagtgtgattgcgcaggcaggggcgaaaggtcgtcaactgcataaatttggcggcagtagtctggcggatgtgaagtgttacctgcgtgtcgcaggcattatggcggagtattcgcagcctgacgatatgatggtagtgtccgccgcaggcagtaccaccaaccagttgattagctggctcaagttaagccagaccgatcgcctttctgcgcatcaggtattacagacgttacgccgctaccagtgcgatctgattagcgggctgcttcccgccgacgcggcagatgatttaaccagcgcttttattagcgatctggaacgtcttgccgccttgctcgacggcggcgtaacggatgccgtctatgctgagatcgtcggacacggcgaaatttggtcggcgagattgatgtccgccgtcctgaatcagcaggggctggatgccgcctggctggacgcgcgcgcatttttacgcgccgaacgcgccgcacagccgcaggttgatgaagggctatcttatcctttattgcagcagctactggcgcagcatccgggcaaacgtctggtcgtgaccggctttatcagccgcaatcatgacggcgaaacagtcctgttaggccggaacggttccgactattccgccacgcaaatcggcgcgctggcgggcgtttcccgcgtgaccatctggagcgatgtcgcgggcgtttatagcgccgacccgcgcaaagtgaaagatgcctgcctgctgccgttgctgcgtctggacgaagccagcgagctggcgcgtctggcggcgcctgttctgcacgcccgcacgctacagccagtgtccggcagcgatatcgatttgcagttgcgctgtagctacacgccggatcaagggtcaacccgaattgaacgagtgctggcttccgggacgggcgcgcgtatcgtgaccagtcacgatgatatctgtctgattgagtttcaggtgccagccagccaggatttcaggctggcgcataaagagctcgaccacattttaaaacgggcgcaggtgcgtccgctggcggtgggcgtgcatcgcgatcgccagctattgcagttctgctataccgccgaggtagcggatagcgtactgaaactcctcgacgatgtcgggctgccgggcgaattgcgcctgcgacaggggctggcgctggtggcgatggtcggtgcgggcgtcactcgcaatccgctacactgccatcgcttctggcagcagttgaaaggtcagccagtggagtttacctggcagtcggaggagggcatcagtctggtggcggtgctgcgtaccggcccaactgagagcctgattcaggggctgcatcagtctgttttccgcgccgaaaaacgcattggcctgatgctgttcggtaaggggaacatcggctcccgttggctggaactgtttgcccgtgaacaaagcacgctttccgcgcgtactggttttgaatttgtgctggcgggcgtggtggatagccgccgtagcctgttgaattatgaagggctggacgccagccgcgcgttggcattctttgatgatgaagccgttgagcaggacgaagagtcgctattcctgtggatgcgtgcgcatccgtatgatgatttagtggtgctggatgtaaccgccagtgcacagttagccgatcagtaccttgatttcgccagccacggttttcatgtgattagcgccaataaactggcgggcgcaagcgccagcgataagtatcgccagattcatgacgcgtttgaaaaaaccgggcgttactggctgtataacgccaccgtgggcgcgggattgccgatcaaccacacggtgcgggatctgattgacagcggcgatacgattctctcgatcagcgggatcttctccgggacgctatcctggctgttcctgcaatttgacggtacggtgccgttcaccgatctggtggatcaggcctggcagcaggggctgaccgaacccgatccgcgcgtcgatctttccggaaaagatgtcatgcgtaagctggtgattctggcgcgcgaggcgggatacgacatcgagccggatcaggtgcgtgtagaatcgttggtgccggcgcattgtgaagaaggatctatcgatcactttttcgaaaacggcgacgcgctgaatgaacagatggtgcagcgtctggaggcagcccgcgaactggggctggtgttgcgttacgtggcgcgtttcgacgccaatggcaaagcgcgcgtcggcgttgaagcggtgcgtccggaacatccgctggcggcgctgctgccgtgcgataatgtctttgctattgaaagccgctggtatcgcgataacccgctggtgatccgtgggccgggcgcgggtcgcgatgtgaccgccggggcgattcagtcggatatcaaccgtctggcgcagttgctgtaataaaggcaagttcgtgagcgaagcgccgggttgcgcttcgctccctcatcaatacgttatgcagtcattctgtagatactgatatacgaagcgccatccgattgctgacgaaacattatggcgtgatgctttttacattctcaacccggacatccatccgggggtaaggaatattgatgccgttttcatccattgcttccttgatattttccagaagatcgtagtaagtactccagtactgagcgttgggcacccatacgcgaacatagaaattcaggctagagggcgcaagttcgcccaagcggaccgtaatatcgcgggttttatcaatgcgatgatcttgctcaataatacgatgtatcacgttttttacgtcagcaatacggctttggtaatccacgccaataatcagatcaatacgtcgataggggtgtcgtgaatagttgataatattatcagcaataattttaccattcgggatgacaacttctttgctatccgcagtgagcagagtggtggagaaaatatggaccttttctactgtgccgataaccaggccaatttgtacaatttccccggcgcggaaaggacgcagggagacaagcagtacgcctgcggcaaagttggaaagtgacccttgcagcgccaggccaatggctaaacccgccgcgccgataacggcaataattgaggaggtttctataccgacacggccaagagcggctactgccgtgaaagctatcgtgatgtagcgaaccagcgcggagaaaaagtggacaatagtggcatccacttgccgcctgagaagtaatttttccagccccctcgatagtaagcgagctattaacttaccgatgaaaagtagaatgatggcggcaacaacattccagccaaaatgaattaccgagtcactgtgctcggccatccatttgatcgcgcctttaatttttggaaataactcaaaaccttccatgtttatcctctgtcagcagtatccgcggtattagcggtaataaaacggttcatttttgcctggataatcgccgcgccgacgggtggcagcagtaacgcccagaatagtgtccagccggttcgtattccgccatcttcgtttttattcgccagcagagcgcggatttcgtcgctaagcgtcagacacaatatggctgtgccaaacggcataatggctgacagccatcccgcgccacatgcggtcatgagtcggggcgaaggcgccacaaattgcatttcccggtgaattctgaagaaccaataaataatataaaatggaatgaaaaagcccaataatgcgacgacaaggggttctgcgcactcaggtcgctgggttgatgagaaccttttgggcggtgcaatatagaaaagttcttttttgagcggtaatagtagcaaaagcgcgataaccgctaaagtaattacgattattcctatataaggaattgagtatataaatatagacagatagccagcgatgataaatttgaacagtaagcagaggctaaataaaataacaaatgtctgagcactgccgatagcgctgaaaagcagcatggggactaacagcgttatgatccccatacccagattaattaaaaactgcgctatgataagcctgactacgtcagacgggccatttatgcagaaggaacagaccacgccaatgattaacaggagcgcaacaaagtagaaggggtaacaattttttatacggcagacaaaccagctggcaaccatacccaggaggtatcccagttggccgcaaacgagaataacaccaatacgatcggctggaatagacagtgatttactccaaaaataaacaccatacgacgatcccagcgaactgataaaagagagcaccaaaaagaaaaaagtgatcccccagaatcgatagctactcaggagatcggcgcaggtccattttttatctgacattgacggtaaagtaatttccatatttatcccttgttttccatagaaaataagaatgtatagaactatttaaattgataataaatattgattatgtgaataacgtttatagccgatcttaacttaaaacgaagggccattttataaaatagttctattctttttcagcgtataaaagcaggatgtgaggtgattaaatctatagcgccttctgaatgataatctgtgattttttatgcgtggcattacatcattgggttaaatgtgattccattgtgaattatatttttccgtcagaaaatacagaatttgcgtgacgcgtttggcggaatagtgggcgctttgctggaattcaggttgttgccatagccaggtaacaaagcggcgactggccgccagattaacggcgacaccttgttctaagtgggaaccggttaacgaacagaccattttgcggttgtgaccttgcccccagagttgccactgattttgccaccatccctgccatgttttgcctaacagttgccactctgcgcggcaatcgtcatcgtttatctcttcctcaacgaaccacagcgaggagagacgctggcgaaaccgctccgcccatgccgtaatgaccgcgccgcgcaaaaaacactcatgggcaatgatgtgtgtcgcgacatcaggaaagcggtttttcagcacccgaaaatgaccatgcgccgtaatgaccgggcgaagtattgttccttgcgcgttacgtttaagcgccgccgggccatactgaatctcatcgaactgacttcgctgtaaaaattgccgttctttaatggcgatacggtgaataatatcgcccttctcgccctcgggcggcgcaattcctttccagtggtaatgcaaactttttccggcagacagtaacgtgaaattgctggaaaggtgaagaatattgccgcgaacagcatcaaaactgaataaaaagtacaattgctggaaggcattcgctccctgaaacggtacgagcagcggaatactgcaaatctgttccggcgtttcggcgacattcagcgcgtgctgttttggcgtccagactttcttacagtactggcactgaagtcgctgcgttccgccgggattacgtccataacgaatccatgttttttgatagcagtcggggcaaaagtgaccatgctctttggcatattgcgcgatataagcagacgcccagcggcgaaattccccctcgttgaagagcggcggataactgccgcaggctcgacaatgcaatgccggataacccaggcgatagtccggccacacataatccggcgagtcaggcagcccaagattgcgacaaccagcgcttttgcaggcattaatggtgaacagaggcggcatacattttaccaacgattttggcaggtcgttgattctgccttcataaaacggtacgcgggtgtgaggactctcacataaaaaaacctttcagaacgtaacgtagcgaatctttatatgactgaaagggacttatttatgaaagtaaaactgcttgctgccggtattttgttcacgctgccgttctgggcctgcgccaaagatgtcaccattatttacaccaacgatctacacgcccatgtggagccttataaagtaccgtggattgctgacggtaaacgcgatattggcggttgggccaatatcaccacgctggtgaagcaggaaaaagccaaaaataaggcgacgtggttttttgatgccggagattactttaccggaccgtatatcagcagcctgacgaagggtaaagcgattatcgatattttgaataccatgcagtatgacgctgccactatcggtaatcatgagttcgatcatggctgggacaatacattgttgcaactgagccgggcgaaattccctatcgtacagggcaatattttttatgaggacagcagtaaatccttctgggataagccgtacaccattgttgaaaaagatggcgtcaagattggcgtaatcggcttacacggtgtctttgcttttaatgatacggtatccgccgcgacgcgcgtgggcattgaggcacgcgatgaaattaagtggctgcaacgttacattgatgaacttaaaggtaaagtcgatctgaccgtcgcgctgatccacgaaggcaccccggcccgccagtccagcatggggaataccgatgtgcgacgcgcgctggataaagatattcagaccgcaagtcaggtaaaagggctggatattttgattaccggccacgcgcatgtcggtacgccagaaccgattaaagtcggtaatacgctgatcctctcaacggacagcggcggtattgatgtgggtaaactggtgctggattacaaagagaaaccacaccactttacggtgaagaacttcgagctgaagaccatttttgctgatgagtggaagccagatccgcaaacgaaacaggtgatcgacggctggaacaaaaagctcgataaagtcgtgcagcaaacggtggctcagtcgccggttgagctgacccgcgcgtatggcgaatcgtcgtcgctggggaatctggcggcggatgcgctgctttttacggcggggaaagacacccagttagcgcttactaactctggcggtatccgcaacgaaatcccggctggcgcggtgacgatgggggcggtaatcagtaccttcccgttccctaatgaactggtcacgatggatttaaccggtaaacaattgcgcagcctgatggagcatggcgctggcttaagcaacggcgtattgcaggtgtctaaagggctggagatgaagtatgacagcagcaaacctatcggccagcgggttaccgtgctgacgctcaatggcaagccgattgacgatgctacggtttatcacatcgctaccaacagcttccttgccgacggcggcgatggttttgcggcattcacggaaggccaggcgcggaacacctccggcggctactatgtgtcgaatgcgatagttgattactttaaggcgggcaacaccatcacggatgagcagctcaaaggaatgcgcgttgcggatgtgaagaagtaatttcccctgccgcggcgcgttcagtgtcgcggcgtgacatgaagaaaattcaactttgctgaatattcctcattctttggcgtgatttttcagttgacgtccttctgcttttccgtcatttttacatctggacgtctaaacggatagatgtttacaacacaacaaataataacatgcgattgatgaggtaaggtatgagcttttttcacgccaaccagcgggaagccctgaatcagagcctggcggaagtacagggtcagattaacgtttcgtttgaatttttcccgccgcgcaccagtgaaatggagcaaaccctgtggaactccatcgatcgcctgagcagtctgaaaccgaagtttgtttcggtaacgtatggcgccaactccggggaacgcgaccgcacccatagcgttattaaaggcatcaaagagcgtactgggcttgaggccgcgccgcaccttacctgtattgacgccacgcgcgatgaactgcgcaccatcgcccgcgactactggaataacggtatccgccacattgtcgctttgcgcggcgatttgccgccgggcagcggtaagccggagatgtacgccgccgatctggttggtttgctcaaagaggtggccgatttcgatatttcagtagcggcctatccggaggtacatccggaagcgaaaagcgcgcaggccgatctgcttaatctgaagcgtaaagtggatgctggcgctaaccgcgcgataacccaatttttcttcgatgtggaaagctacctgcgttttcgcgaccgctgtgtttctgccggtatcgacgtagaaattattcccggcattttaccggtgtctaactttaaacaggcaaaaaaatttgccgatatgaccaatgtccgcattccgtcctggatgtcactgatgtttgaggggctggataatgacgcagaaacccgcaagctggtgggcgctaacattgcgatggacatggtgaaaattttaagccgtgaaggagtgaaggatttccacttctacacgttgaatcgtgcggaaatgagttatgccatttgccacacgctgggcgtaagaccgggtttataacctccagctccctgccgggagctttattacaactcatattgatctacatctctgtaactaaaaatataaaaggtattagctatcgaatctgtggattaattcaactatatctatttgctcctggtgtatatcgtaacggtaacactttaaaagggagctgagatatgagcacgaccgacgatacccataacacgttatccactggaaaatgtcctttccatcagggggggcatgaccgaagcgcaggcgcagggactgccagccgcgactggtggccgaaccagcttcgcgtggatcttttgaatcaacattccaaccgttctaacccgctgggtgaagactttgactaccgcaaagagtttagcaagttagactactccgccctgaaaggggatctcaaggcgctgctgaccgattcacaaccgtggtggcccgctgactggggcagctatgtcggtttgtttattcgcatggcctggcatggcgctggcacctaccgttctattgatggtcgtggcggcgcgggtcgtggtcaacagcgttttgcgccgcttaactcctggccggataacgtcagcctggataaggcgcgtcgtttgttgtggccgattaagcagaaatatggccagaaaatttcctgggccgacctgtttattctggcgggtaacgtggcgctggaaaactccggcttccgtaccttcggtttcggcgccgggcgtgaagatgtctgggaaccggatctggatgtgaactggggcgatgaaaaagcctggttgactcaccgacaccctgaagcgctggcaaaagcgccgctgggcgcgaccgagatgggccttatctacgttaacccggaagggccggatcacagcggcgaaccactttctgccgccgccgctattcgcgctacctttggcaatatggggatgaacgacgaagagaccgtggcgttgatcgctggcgggcataccctcggtaaaacccacggcgcggcagcggcatcccatgtaggggccgatccggaagccgcgccgattgaagcgcagggcttaggttgggccagcagctatggtagtggcgttggcgcggatgctatcacctccgggctggaagtggtctggacgcagacgccgacccagtggagcaactatttcttcgagaacctgttcaaatatgagtgggtacaaacccgtagtccggctggcgctatccagtttgaagcggtagacgcgccggacatcatcccggacccgttcgatccgtcgaaaaaacgtaagccaaccatgctggtcaccgacctgacgctgcgttttgatccggagttcgagaagatttcccgtcgtttccttaacgatccgcaggcctttaatgaagcctttgctcgtgcctggttcaaactgacgcacagagatatgggaccaaaagcgcgttacatcggaccggaagtgccgaaagaagatctgatctggcaggacccgttgccgcaaccgctctatcagccaacgcaggaagacattatcaacctgaaagcggcgatcgctgcatccgggctttctattagcgagatggtttcggttgcctgggcatccgcgtctactttccgcggcggcgataagcgtggcggcgctaacggcgcgcgtctggcattagcgcctcagcgcgactgggatgtcaacgccgttgcggctcgcgttctgccggtattagaagagatccagaaaacgacgaataaagcctcgctggccgatattattgtgctggcgggcgtggtcggtatcgagcaggcggccgctgctgcgggtgtcagcatcagcgtaccttttgcgccgggccgggtggatgcgcgtcaggatcagaccgacatcgagatgttctcgctgcttgaaccgattgctgatggattccgtaactatcgtgcgcgtctggatgtgtcgacgaccgaatcgctgttgattgataaagcgcagcagttaacgttgaccgcgccggaaatgacggtactggttggcgggatgcgtgtgctgggaaccaactttgacggcagccagaacggtgtctttaccgacagaccgggcgtgctcagcactgacttcttcgctaatctgctggatatgcgttacgagtggaagcccaccgacgacgctaatgagctgttcgaaggccgggatcgtctgactggcgaggtaaaatacacggcgacccgcgccgatctggtgtttggttccaactccgtactgcgcgcgctggcggaagtttacgcgtgtagcgatgcgcacgagaagtttgtgaaggacttcgtcgcggcatgggtgaaagtgatgaacctggaccgtttcgatctgcaataatctgacaggttaattcgtcagcggctgctattcggtagtcgctgacgttttcctcgtttaatgcgaaaaataacgaaaatgccccgtgactttccagttaaataatacatcttcctcctgtgctcccgcgcctatgttatgcacaaccagcggcaccccttcaggcgtgacgttcagggataccacgccaatatgcgcaaggccgttatccagtcgccaggagacaatatctcccggttgataatcgctatatttatctgtcaccggcaaagctttgttttgacgctggaaccaggtttccagattcggaacgcggcgatggtcgatattgctgtccgggcgtttcagcttccagttattcgggtaggcagagaaatgcgcctgcatgtcttcatgtacccgtttctgtaaatcaacctgctgactgcgcagcgcgcggatgacgacatctgcacatacgccacgctccagcggaagatcgccattcggataatccagacgaacataggcagcatcataaaatagcgtcttacctatttgcgtcccggcactttgggcgattgcagcattagtttgcgcctgaacggttattggtctggtatcagagcgtggcgaatgatgagagatatggctaataaaaaaagcagcaagaataccgataagcgcctgtgcgaatttcatcttcttcgtccgtgaagtgtgtcagtacgtcatttgactttccgcggagagaatggtgcgtgataaaaaagtctatttcaggacaaaatggactgattccaggctatggaatacctgatgatggcgcttcgcttacccggcctggatgattggataacaaggccagataaggtgcctgtgtcgatattcggcaactgaattctgttgggtcagcaagctgaaatactcctgactatcgtcaggagtattgctcagaccttattcccattcctgcaagaagcgttgaccgtactggtcggcgaccagcagcgcggcgtacacttcatccggcgttgcgccgccaggcatgttatgaatagtttcaccttctgcgcaggaggcttccgcgacggtgcgcatcttggccggaatatcctgtttaatatccagttgcgccagcgtaatcggcaggccaacggaatggcacagcgccgcaacggtttcgatttcttcgaccggcgcgttttccagcaccagttgcgtcagcgtaccgaaagcgaccttctcaccgtgataatagtggtgcgcatccggaatcgccgttaaaccgttatgaatcgcgtgcgctgcggccagaccgccgctttcaaaaccgaccccgctcaggtaggtgttggcttcgatgacgcgttccagcgctggcgtgacgacgtgctgttcggcggccaacatggctttttcgccttcttcgatcagcgtgttatagcatagctccgccagcgccagcgcggcctgtgtacacttgccgcccgccattgtggtggcgccgctgcgtgagcaggcgcgcgcttcaaaccaggtcgccagtgcatcgccgataccggctgccagcagacgcgccggcgcgcccgccactatctgcgtatcgacaataaccatattcgggttatgcggcagcagcagataacggtcaaactcaccggcatcggtataaataaccgagagtgcgctgcacggtgcgtcggtagaggcgatggtcggcgcgatagcgaccgggacgttcataaagtgcgccagcgctttggcggtatccagcgttttaccgccgccgatacccagtacggcgccacactgacttttttcggcgacggcgcgcagcctgtcgatctcattttgcgaacattcgccgccaaacggggcgatttctactgacaaaccggcatccgtcaggcttttgcgcagcgtctcttcggcaaatcccagcacgaatttatcgcccacaaccagccagttgttcgccattggttttaaataatcgccaagacgcgcgatgacgtttgcaccctgaatatacttacctggtgactgaataatgcgatccatacatttctctcctacaggttcagattaccaaaagcgtttttccagtcttgctcaaacttctctattgccgactctaccgcaggcgtattgagcatttgttgcgctacatctaaaggaagggtaatcgcctggcaacctgccagtaagcaatccagcgcctgccgcggcgttttaaagctggccgccagtaccatgctgtcgggcgcgtgatgttccagtagcgtttgcagctcctgaaccatacgaatgccatcgccgccctgcgcatcaacgcggttgacgtagggagcgacatattttgcgcccgccagcgccgccagcaggccctgcgatgcgctgtagacggcggtgcccagcgtcacgatgccttcttttttcagcaatttaatcgctgcaagaccttcggcggtcaccggaattttaaccacaatgccggggatggcgttattcagtcgtttggcttcttccaccatccctttcgcgtcgcggctcatggtctgcgcaaataaagtgccttcttcgccgatggcgttttgcagcctgggcagcacatcccagatagattctttgctggctgccacaatgcttggattggtggtgacgccggcaatcgggaaaatgcgcgccagacgttcaacttccgccacgttagcggtatccagatagagttccatagtctttcctttacagttcaagttcatgttgcagcaggctggcgatagcgtcggcggaagcggcgttaaccagcgtgttgcggaattcttcgtgcatgatgcggcgggccaggcgcgagaaaatacgcatatgctggtcgcccgcggcgtgtttgttaagcgtcagcataatgatgaactgcgcctcgtcatctccccagcgtaccggcgcgttcaggcgcgccacgctgatggtggactgttcgatatgttccgatttgctgtgcggaatggcaaagctaaagcccagtccggtggagaataccgcctcgcgcgcccatagatcggcttccagtttgcgcgggtagcggcagcggcccgccagcagcagattgtcggtcatgcctttaatcacctcctctttgctgcgccagtcgctatcaagcgttatgcattgggcggtaaccagcggggcatcctgctgcgacatgcggaactgcgccagcagatgctccacctccagcgaggtgcggcaggccatcgcctgattcaacaactggcggcaggctcggctgtcgagttgtgccatccgcgctttggcggcgggaatcgacggcgcgcccatgctgatctcgtccagccccagacctaccagcaatggcagaaccgaacctttggcccccagttcgccgcacagaccaatccatttgccctgacgatgtaccgcctgcaccgcgaaatccaacgcgcgcaggaaggcgggattcaggctgttgtagtgacgagtgactttggcgttatcacggtctaccgccagcaggtattgtgttagatcgttactaccaatactaaagaaatcaatctcttcacagcattgatcgatgatgaacatcaccgacggcacttccagcataatgccgagtgggatcttctcatcgaacgggatatgttcattacgcagctgctgtttggcttccgccagcttctctttgacccacagaatctcttccatagaggagatcatcgggatcatgattttcaggttgccgtgggcggacgcgcggaggatcgagcgtagctgggtggtaaacagagaagcgtactcttcataaatacggacggcgcgatagccgaggaatgggttggcttcggcaggaatattcagataatcaacgggcttatcgccgcctatatccattgtgcgcacaataatgctgcgtccctttgcggactccagagcctggcaaaaaatattgtacagctcgttttcgtccggcgcgcaggcgcggtccatatacagcatttctgtgcggaacaggccaaccgcttccgcgccgttactaaaggccgcttgcgcctcgacggagtgcgcgatgttggcggcgacctccatgcggatgccgtcagcggtgcgcgcttcctgggtcagccagatgcgctgctgttcgcgcagggcgtcttgcacgcgggcttcctgctgatagtaacgagtgacaggctcgtcaggcgcaacgacaatcgcgcctgcgttgccgtcaatataaaccgtctgctgacgccacggtgttaaggcctcaatctccacgccaaccagggtgggaatgttgaatgagcgggcgagaatcaccgtgtgcgaagtggtgccgccgctttttaacagcagacctttgagaaaggttttatccagttcgaggaactggcttggcgtcaactcttccgccatacagatagatggccgggtcaactggcccggcgccggaaagcgctgcccaccgtaaatgtgttgcagtaactggaagcaaacgtcacgaacatccagcgcgcgttcctgtaaatagctgctgctggcgcgagcgaactcattgcagaaatggttcgcgctttccacgattgcctgcgcgcagcttaaaccgcgcagaacgccgtccagtaaatgctgacgcagtgaagcgtcgcctgccagtgaacgatgggcttccagaatcgcgctggcggcaccgtcactgtcgagctgacgaaactcaatatgctttatcaacatcgctaagccattgtccagcgcggcttgttccgtctctgtgtcgttggcggtcgggagttcgccgagcgcattgagatccagggaagagagtggcgtcagtacgccgcccgcgctgccgctacacacgctacgggcgcggtaaatctgcggattcagctgggtcaacgacgccggaagcggctccagttcgctgtttttaatctccgccagcggcgcgtcgcagagtgggaattcatcgcgcagccattgactcagacgctgacaggcaacctgttcatcggcaccggaaatcaccagctgacagtggtcgccagccagcgtgtcggtgccaatcagcgccagcgcgcttttggcgctgcctttgcgatcggtgcgcaggttgtgccactcaatttgcgacgtgaaggtattacacagcgtttctacgtggcttgccgggcgcgcatgtacgccattcggcagttcacaggtaaattccacaatcaggggcattgcctctctcccataacgattctctcgctacagcataaaaggaggtagccggaatacgccatgtgacaaatctgtcaaaagctggataaatgtaatgtagcgcaaaaagtgcgagttgtctcacaacttagcgtggtagcgcgggttttacctttttcagaagttatgaagcggatcgcatttttatactgatattacaaaaatccagtaaatggcctttttatccactgtctgcgcggcaatggattgcctattgttttccgcagtaactttatggacatgggctttatccagcccgggagcgacttatgaaagagttggtacagatcctgaaaaatacccgccagcacctgatgaccggtgtttcgcatatgatcccctttgtggtggctggcggaattttgctggcagtctccgtcatgctatatggcaagggcgccgtacccgatgccgccaccgatccgaatcttaaaaaactgtttgatatcggtgtcgccgggctgacgctgatggtgcctttcctcgccgcatacatcggttactccattgccgaacgctccgcgctggctccttgcgcaattggtgcctgggtgggtaacagcttcggcgcgggttttttcggggcacttatcgccggacttatcggcgggatcgtggtgcattacttgaagaaaatcccggtgcataaggtgctgcgttctgtgatgcctatttttgtgattcccatcgttggcacttttatcaccgcgggcatcatgatgtgggggctgggcgaaccgatcggtgcgctgacaagcagcctgacccaatggctgcaagggatgcagcagggcagcatcgtgctgctggcggtgatcatggggctgatgctggcttttgatatgggcggcccggttaacaaagtcgcttatgcgttcatgctgatttgcgtggcgcagggcgtatataccgtggtggctatcgccgcggtgagcatctgcgtaccgccactgggactggggctggcgacgctgattggccgcaagaatttttctgttgaagagcgcgaagccggtaaagccgcgctggtcatgggctgcgtgggcgtaacggaaggggcgattcctttcgccgctgccgatccgctgcgcgtgatcccatccattatggtgggctccgcttgcggtgcggtaatggccgcgctgtttggcgcgcagtgttatgccggttggggcggtttaattgttctgccagtcgtggaaggcaagctgggttatgtcgcggcagtcgccgtgggcgcggtggtaacggcagtctgcgttaacgtgctgaaaagcctgacgcgtaagaatgtgtcgcaagttgacgaaaaagaagacgacctggatttagattttgagatgaattaagcgaggaataagccatgactaaaattattgcagtaaccgcgtgtccttctggtgttgcgcatacctatatggcggctgaagcgctggaaagcgcagccaaagcgaaaggttgggatgtaaaagtggagactcagggctcgattgggctggaaaatgaactgacggcagaggatgtggcgagcgccgatatggtgattttgactaaagatatcggcatcaagttcgaagagcggtttgcgggtaaaactatcgttcgcgtcaatatcagcgacgcggtaaaacgcgccgacgccattatgaacaagattgacgcccatctttcgcaaaccgcgtaacgttaaaatgcccgatggcgcaagtttatcgggcctgctcacaggcccgataagagatttatgccgccatccggcgctcgtgtccacaggagctcctcatgacccatcgtattcaacgcctcaaagccgctctgtttcagaatcaccgtgaaatttctctggagcgcgcgctgctttataccgccagccatcagcagacggagggcgaaccggtcattttgcgccgcgccaaagcgacggcgtatatccttgaacatgttgaaatttcgattcgtgacgaggagctgattgccggaaaccgaaccgttaagccgcgcgcgggtattatgtcgccggaaatggacccgtattggctgcttaacgagctggatcggttcccgacgcgtccgcaggaccgttttgatatcagcgaagaggataagcgcctctatcgtgaggttctattcccgtactgggaaaaacggtcgatgaaagattttattaacgggcagatgaccgatgaggtgaaagccgccgtcagcacccagatttttagcattaaccagacggataaagggcaggggcatatcattattgattatccacgcttgctcaataacgggctgggtgaactggcggcgcagatgcgcgcgcgctgcgagcaacagccggaaaacgacttttatcaggccgctctgttgttacttgaggcatcgcaacgccacatcctgcgttatgccgtactggcggaacagcaggcggagcgctgcccggacgctcgtcgtcgtcaggaactgctcaccattgccgccaattcgcggcataacgcgcagcacaaaccacagacgttctggcaagcatgtcagctgttctggtacatgaacattattttgcagtacgagtccaacgccagttcgctgtcgctcgggcgcttcgaccagtacatgctgccgttttatcagacttcgctcactcagggcgacgatccggcgttcctgaaagagttgctcgagtcgctgtgggtgaaatgcaacgatatcgtgctgctgcgttccaccagtagcgcgcgctattttgccggtttcccgacgggttacaccgcgctgctgggcggattgacggaaagcggacgcagcgcggtaaacgtgctctcttttctctgcctggatgcctaccagagcgtgcagttgccgcagccgaatctcggcgtgcgcactaacgcgctgattgatacgccgttcctgctcaagaccgccgagaccattcgcctcggtaccggcattccacagattttcaatgacgaagtggtggttcccgcgttccttaaccgtggcgtgtcgttggaggatgcgcgcgattatgcggtggtgggatgtgttgagctgtcgattccgggcagaacctacgggctgcatgacatcgccatgtttaatctgctgaaagtgatggaaatcagcttgtatgaaaatgagggcaacgacactcttacttatgaggcgttgctggcgcatattcgcgccaaaatcagtcactacattacactaatggtagaaggcagcaatatttgcgatatcggccatcgtgactgggcgccggtgccgctgctctcttcgtttatcagcgactgcctggagaaagggcgagacatcaccgacggcggcgcgcgctataacttttcgggcgtacagggcatcggtatcgccaacctgagtgattcccttcatgcgctcaatgggctggtattcgatcagcagcgcctgagttttgatgcgctgctgtcgatcctgaaaaacaacttcgccacgccagaaggggaaaagatccgcgccaggcttatcaaccgcttcgaaaaatatggcaacgacattgataatgtcgataacatcagcgccgaactgctgcggtattactgcaaagaggtggaaaaataccagaatccgcgcggcggccagtttacgccgggttcatacacggtttccgcgcatgtgccgctgggagcggtggtcggcgcgacaccggacgggcgttttgccggagaacagctggcggatggcggcctgtcgccgatgctcggacaggatatgcaagggccgacggcggtactaaaatcagtaagtaagttggataacacgctgctgtcgaacggtacgttgctgaacgtgaagtttactcctgcgactctggaaggagaggcgggactgcgcaagctggcggatttcctgcgcgcgtttacccagctcaaactgcagcacatccagtttaatgtggtgaatgccgacacattgcgcgaagcgcagctacggcctcaggatttcgctgggctggtggtgcgcgtggcgggctacagcgccttctttgtcgagctgtcgaaggagattcaggatgacattattcgccgcaccgcgcatcagttgtgaggttgtgggggcgcgcgatgaggagaccgcgcgtatcttcaatatccagcgctattcgctgaatgacgggcaggggattcgtacggtggtcttttttaagggctgtccgcatacctgtccgtggtgcgctaatccggaatctatctcgccgcgcattgaaacggtgcgccgggaaaataaatgcctgcgttgcacgccgtgtctgcgggatgccgacgaatgtccttccggcgcgtttgagcgtattgggcgtgatattacgctggatgaactggaacgcgaagtgctgaaagacgacatcttctttcgtacttccggcggcggggtgacgctttctggcggcgaagtgctgatgcaggcgccgttcgccacgcgcttcttacagcgattgcggcgttggggcgttccttgtgctattgaaacggctggcgatacgtcggccagccgtctactgccgttggcaagggcgtgtgatgaggtattgtttgatctgaaaattatggatgcggagcgggcgcgcgaggtgatcaacatgaatctgccgcgcgtactggagaatttacggttactggttagcgagggaatcacggtgatccctcgtttgccgttgattcctggctttacgcttaacgcagagaatctgcagtgcgcgttaacattgttgagatcattaggaataaagcaggttcacctgctaccgtttcatcagtacggcgagccgaaataccggctgcttggaaaatcatggatgatgaaagatattcccgcgccgtcggtgcaagagatcgctctgtttcgggagatggcggagcaagcaggatttcaggtcaccacaggaggttaatatggcagtacctgtacggcatctggtggcagtgaccgcctgcgtgagcggtgtagcgcatacctatatggctgctgaacggctggaaaaactttgccagcaggagaagtggagcatcaagattgaaacccagggggcactcggtacagagaaccgcttaacggaagaggatatccgccgtgccgatgtcgtgttgctcattaccgatatcgagctggcgggcgtggagcgatttacccggagtcgctatgtccagtcggggatcagcgcttttttgcgggagccacagcgggtaatgagcgctgtgcgtaaactcctttccgcgccgcaacatacccaccttatcctggagtaatctgcttttccgttagctggctgtgatactggcggcgatactccgacggcgagcgttccgtatttttgcgaaacaggcggcagaaatagttactgtcgacaaagccgcagcggtgcgccacctctttcactttcaggtcataacccttcagcaacgttttggcgtgttccagtcgcgtatggttcaggtattcgttaaagccgatggcccccgttttctggaacaggtgcgagaggtaatttggcgagatataaaacgcctgtgctaccgattcgcgcgtcaacggcgcggcgtagcgttcatcaatatactcccgaatggcttcaaaaagcgcgcggctgcgggaggcggtctggatttggctgccgagcagatcgcggcaatggcttagtaggctggcgacaatcaatctggccgtttgctgctcttgcggctgcatctgcatctcattaagcgtttgtaacaggaacgagccgatacgcgggccgcggcgcgcaacgtgctgtttcgtgaggttttgatgctgctgaccatcccagtggactacgctgaaacctaactgctgtttgccaaacagaatgctcagggtggtgacgggcgtttgccattgcgggatgttccagccgccagccggaacgtagagaacatcgcaaggaatgagcggggcggtaatgctcatgtcagtaagctcgccctccagcacaatctccagccgcggaaaatccacctggtacgccagttccggcgctgggccgctggcgctggcaaaataaatctggcgcagcggcagcgggccgttgatgagacgggagagaaggtggctgacgtcgtgatacatgataatcccctgccgatcgcaaacagaggaaacagtaacgtcgaaaaccgatgtcctcaagcgattattgccggatagcggcgctttgcgccttatccggactacgggagagaagcacgccaggcccgataagcgttagcgttatcgggcaacatacaggctattgattaccgacctgatcgccatacggcaacgtatcataatcaatcagcgcgtttttcttatacgggttgccaatccagcgcgtggtctctttgaactgcgggttggtgatggaacgcgtcgggtcgtagccatcataggtcaggcccgctaagtccgaccaggtatggataagctcggaactgctgtacttacgatcgacatcctgtgagaagtcgcgcggatgcgctgcctgccatttctctgaggtccacagcaggaacggcaccgtatacatatgacgggttggcgaatcttcgtttcgtccctgcgtcttatgcggcggcgtgtcatacacttcttcaccgtgatcggagaagtagagcaggaaaccgttcggatcggtcgctttatagtccttaatcaggctggcgacaacatagtcgttatacaggttcgcgttgtcgtaatcattatacgattccagctcgtcactgcttaatcccggcggaacatggtcggttttaccatcaaacttgccctggttttctggatagcggaacttgtatttaatatgcgttcccagcagatgcacaataatgaattttttcggcgccgggtcggctaacaccgctttaaacggcgccagcacgttgctgtcatattcgcgcgcgctttgagtgcgctgctggttcatatagaactgcttatcagtctgcttggagaacacggtcagcatggtattacgcgccgtcatcgtctgctggttagtgatccagaaggttttatacccggcctgtttcatcatattcatcagcgatggcttcgtcagataccagtccgggttcttttcgtccgcgaacgttagcgcctgttgcaggatctcaatggtgtacggtcgcgaagttaccacgttattaaacacggtcagcccggggtcggttttatgcagcgcgtccagttccggcgtggtttcgcgcggataaccgtacagactcatacggccacgctgggtcgattcgccaatcaccagtaccagcgtgcgcggcgcatcgccggagtggtcctggaagttagccagcggcggcagggcatcgttttcattcagcagtttattcagcgaggcgagctgtaaacggtactgatagtagccagtaataaattgccacggcgcggcgggttccattcgtgatgccaggctatccagcgttttctccatcgacttatgcttgataaaggtattcatcgcgatgggatggaggatcagcccgtacagcagggcaaacgacaccagataacgccagggggatggaatataaaccgggcgcagacgtgtccacagcaaaatcgccgccaccgtataagccagcgcgacaagaacaattttcagactgaaatattggcttaaatattcgctggcttcattggcgttggtttcaaacatcacaaacagcacgctttgcgagaactcctgcccgtagattacgtaatagctcagcgccgccagcgaggcggcccagagtacgacgccaataacggcagcaataacccggatgcggcctggaaacagaaagaccgggatcagccacagtgagctgtacagtagcgaatcccgcagaccgtttgtcccgctgtatccggtgagataaataatggcctgcaggagggtggaaaagaaccaaaagtagagcagtgcccagcccagggctttccagctaaacgcgggtttagtctggagtaatgtggattgcataatgagagcctgtctttaatcgtagcgccaaacgtaacgcctgaaccttaaaagaatctgaagcaaacctgctttatgccgcacgttttgctaagaaagatttacaaatgcataaaatgcagacagaaatatattgaaaaaatgacgaggatgacagcagtatttcatgccgcccccacataactgcgtgagagcggctctcttttggcgttagccggtgttgcgcataccggcagcgacgcccgcaatcgtgaccatcaacgcctgttcgacgcgaggatcgggcgatttgccctgctcttcagtcagacgggaacgatacagcaattcggcctgcaacacgtttaatggatcggtataaacgtttcttaactgaatggactccgcaatccacggtaagtcggccatcaggtgcgaatcgttggcaatcgccagcaccactttaatgtcttcttccagtaggtctcgtagctctttgcccagcggccaaagcgttttcgccaccaggcgctgatcgtaatagtcggccagccacaggtcggctttcgagaacaccatttccagcatcccaagacgcgtggagaagaacggccagtcgcggcacatggcttccagttcgctttgtttaccgtcttccaccactttttgcagcgcagtacccgcgcccagccaggctggcagcatcaggcggttttgcgtccaggcgaagatccacggaatcgcgcgcagcgattcgacgccgccagttggacgacgtttcgccggacgtgagccgagcggcaatttgcccaactcttgctccggcgtcgcggagcggaagtacggtacaaagtctttattttcgcgcacgtagccgcggtaggtttcacaggagatgacggaaagctcatccataatatgacgccagctgtctttcggttccggcggcggcagcaggtttgcttccagaattgcgctggtgtagagcgagaggctgctgacggtgacttccggcaggccgtatttgaagcggatcatctcgccctgctcggtcacgcgcagaccgcctttcagactgcctggcggttgcgaaagcagcgccgcgtgggctggcgcgccgccacggccaatagatccgccgcggccgtggaagagggtaagctcgatgccggctttttcacaggttttgatcagggcgtcctgcgcctgatactgcgcccatgacgcggccataacgccggcgtctttcgccgagtcggagtagccgatcatgaccatctgcttaccctgaatcagtccgcgataccagtcgatattcaacaactgggtcatcacgtcgtcggcattgttcaggtcatcgagggtttcaaacagcggcgcgaccggcatggcaaagccgatacctgcctctttcagcagcagatgcacagccagcacatcagacggcgttttcgccattgaaattacgtaggcggcgatcgatccttttggcgcttcggcaataaccttgcaggtttcaagcacttcgcgggtatcgttgctcggctcccagttacgcggcagcagcggacgtttggagttcagttcgcggatcaggaaggcctgcttgtcggcttccgaccagctttcgtagtcgccaataccgaggtagcgggtaatttcgcccagcgcttcagtatggcgggtactttcctggcggatatcaatacgcaccagcggtacgccgaaacacttcacgcggcggagcgtgtcgagtaactcgccgttggcgataatgcccatgccgcaggcctgtaacgactggtagcaggcgtacagaggttcccagagctgctcgttttgcgtcagcaggccagccggtttgggcagcttctcgcctttcagacgcgcttccagccaggactgggtcgccatcagacgggcgcgcaattttttcatcaggtagcgatacggctcagacgcgccttcttcgcccactaacgccagcagctccggcgtggcgtcgaccatcgacagttctgataccagaacatgaatgtctttcaggaacagatcggtggctttccagcggcttaacaagagtacgtggcgggtgatatccgccgtcacgttcgggttgccgtcacggtcgccgcccatccaggaggtaaaacgtaccggcacaaaatccaccggcaatttgtagccgagattttcttccagctgttcgttcagttcacgcagatagttaggtacgccctgccacaggctgttctcaaccacggcgaagccccatttggcttcatccaccgggcttggacgctgcttgcggatctcatccgtatgccaggattgggcaatcaactggcgcaggcgacgcattacctggtggcgttcgtagtcggcgatatcggtattatcaagctgttttagacagttgttgatttcacccattttgtgaataagcgtacggcgggtaatttctgtcggatgggcggttagcaccaactccagagacagcgactctaccgcttttttgatggttgcgtcgttgaggtccggttggtttttcagtttgcgcagagtgcgggcaatcacttccgggttgctggcggcttcgccttttggcgaaatgctgtggtattgctcggcagtattggccaggttcaggaactgactaaacgcgcgcgcaactggcagcagctcgtcattagacaaattttgtagcgtggtgagcagctcctggcgattagcttcattgccggcgcgtgaagatttggatagcttacggattgtttctacgcgatcaagaatgtgttctcccagcgcatccttgatggtttctcccagcaccttgccgagcatactgacattactacgcaacgcggaatattgttcgttcatatgaccccagacaccccatctttaatgtaattgccctgtctctttcatgccacagcggcagtggctgcgctcgcccgtatgccagttctgcggaatgggctcgtttgccgccttgctgtgacgtgaaatttttcggactttgctttttagccgtcttttataaagccacgtaaaacccgtggcgtcaattactgcgaaatcggttcagcaaacgaagaaatgacggtaatttattaaagttaattcgcatcgtgccaaataagaaatgcttatgaacatgtggcgtagagacgccggatggcgctgcgcttatccggcctacaagacggggtaggcccggtaaacatcacgtcaccgggcaatatgcattaatgccagcaaaaatggtgtactacctgggtaatcaattcccgggttggcttaataaaacgcgtttcgagatattcatccggctgatgcgcctgattaattgagcccggaccaagcaccagcgttgggcataatgtctgcataaacggcgcttcagtacagtagttcaccacgtcggttttcgttcccaacagtttttctactacttcaaccagttggtggtccggtggacactcataacctggaatcggcggatgtaattccgccaccgtcaggcggcccggccagcgttcgcttaccggggccagcgcgtcgttaagcagtccattaaggtcgtttaacgtcatgcccggcagtggacgaatatccatatgcaattcgcagcaggcgcagatacggtttgaggcatcgccgccgtgaatatggcccagattcagcgttggatacggaacggtaaacgcctcgtagtgataccgcgctttcagcgagtcacgcagttgcatgatatggccaatcgcatcgtgcatcagttcaatggcgttaaccccacgcgccgggtcgctggaatgaccggactgccccaggacgcgaacgacattagagatatgccctttgtgcgcgcgtatcggttgcaacgacgtcggttcgccaatgatcgcgcagtccggacgtaatgccgtggttttggaaaaataacgcgcccccgccatgctggtctcttcatcggcggtcgccagaatgtagagcggctttttcaactttgtgacgtcaacgtcacgtagcgcgtccagaataaaagcgaagaagcctttcatatccgcagtgcccagaccatagagcttattgtcgtgctcggtcagcgtgaacgggtcgcgcgtccagcgtccgtcatcaaagggaaccgtgtcggtatggccggtcagcagcaaaccgcccgcgccatgtccggtgctggcgagcatattaaatttgtttcgcgttcctggaaccggttgaacctctacgttgaaaccaagatcgctgaaccagcctgcaagcaaagtgattaaagacgcattactttgatccagggattcttcggttgcgcttatcgacggtgtggcaatcaaagcgcggtaaatctcgataaatggcggtaaaacgtttttcattgttgacacacctcaggtcatgatagtatcaatattcatgcattaattatgaataaaaatacattaacgttgagcataaaggaacccgatgttgaatacgctgattgtaggcgctagcggttatgcgggcgcagagcttgtaagctacgtaaatcgccacccacatatgaccataaccgctttgaccgtctcagcgcaaagcaatgatgcaggaaagttaatttctgatttacatccgcagttaaaagggattgtcgacctgccattgcaaccgatgtcggatgtacgtgactttagcgcagatgttgatgtggtgttcctggcgacagcgcatgaagtgagccacgatctggcgccgcaatttttacaggccggatgcgtcgtattcgatctttccggcgcgtttcgggtaaacgatcgcgccttctatgaaaagtattacggatttactcatcagtatcctgagctgctggagcaggcggtgtacggtctggcggagtggaatgtcgataaactgaacacggcgaatctgattgcggttcctggttgctatccaaccgcagcgcagttgtcgctaaaaccgctgattgacggcgggcttctcgatctgacgcagtggccggtaattaatgccaccagcggggtgagcggcgcggggcgcaaggcggcaatatcgaacagtttctgtgaagtgagtttgcaaccgtatggcgtgtttacgcatcgtcatcagccggaaatcgccgtccatctgggcgcggaggtcatcttcaccccgcatctggggaatttcccgcgcgggattctggaaaccattacctgccgcctgaaagcgggagtaacccatgcgcaggtcgccgacgtgttgcaaaaagcctatggcgacaaaccgctggtgcgcctgtatgacaaaggcgttccggcgttaaagaacgtcgtcgggctgccgttctgcgatattggttttgccgtccagggcgaacatctgattgtggtggcaaccgaagacaacttgttgaaaggcgcagcggcgcaggcggtgcagtgcgctaatattcgttttggcttcgctgaaacgcagtctcttatttaagggtgaaatgatgaatccattaattatcaagctgggtggcgtattactggatagcgaagaggctctggaacgtctttttaccgcgctggtcaactatcgtgagtcccatcagcgtccgctggtgattgttcacggcggcggttgcgtggtggatgagctgatgaaagggcttaatttgccagtgaaaaagaaagacggcctgcgcgtgacgcctgccgatcagattggcatcattaccggcgcgctggcgggaaccgctaacaaaactctgctggcctgggcgaagaaacaccatatcgcctctgttggtctgtttctgggcgatggcgacagcgtaaacgtgactcaactcgatgaagcgttaggccacgtcgggctggcgcagccggggtcgccgaagctgattaacatgctgctggaaaacggctttctgccggtggtcagctccattggcgtaacagacgacggtcaactgatgaacgtcaacgccgatcaggcggcaaccgcgctggcggcgacgctgggggccgatctgatcctgctttccgacgtgagcggtattctggacggcaaaggccagcgtatcgccgaaatgacggcgtccaaagccgagcagcttatcgaccagggcattattaccgacgggatgattgtgaaagtgaatgcggctctcgatgctgcgcgggcgctggggcgcccggtggatatcgcttcctggcgtcatgcggagcaactgccggcgctgtttaacggcacgccgattggcacgcgtattctggcttaactatttgttcgcccgatggcggctgcgtcttatcgggcctatgtgaacagaaattgtaggccggataagcgtagcgccatccggcagtgaaattcgaagaatttaaggaagtctattatggcactttggggtgggcgttttacacaggcggcagaccagcggtttaaacaattcaatgattcgttgcgcttcgattaccgtctggcggagcaggatattgtcggttctgtggcctggtccaaagcattggtcacggtaggcgtactgactgccgatgagcaacgacagttggaagaagcgctgaacgtgctgctggaagaggttcgcgcgaatccgcagcaaatcctgcaaagcgatgcggaagatatccatagctgggtggaaggtaagctcatcgacaaagtgggtcagttgggtaaaaagctgcacaccgggcgcagccgtaacgatcaagtggcgacggacctgaaactgtggtgcaaagagacggtgagggaactgcttaccgctaaccgccagttacagagcgcgctggtggaaaccgcgcaggcgaaccaggacgcggtaatgccgggatatacccatctgcaacgcgcgcaaccagtgactttcgcccactggtgtctcgcgtatgtcgaaatgctggcgcgcgatgaaagccgcctgcaggacacgcttaaacgtctggacgtgagtccgctaggctgcggcgcgttggcgggaacggcctatgaaattgaccgtgaacaattggcaggctggctgggctttacctctgcgacccgcaacagcctggacagcgtgtccgatcgtgaccacgtactggaactgctttctgatgcggctatcggcatggtgcatctgtcacgcttcgcggaagatctgattttctttaattctggtgaagcgggctttgtagagctttctgaccgcgtgacttccggttcatcgttaatgccgcagaagaaaaacccggacgcgctggagctgattcgcggtaagtgcggtcgcgtacaaggggcgctaaccggcatgatgatgactttaaaaggtctgccgctggcgtataacaaagatatgcaggaagacaaagaagggctgttcgatgcgctcgatacctggcttgactgcctgcatatggcggcgttggtgctggacggtattcaggtgaaacgcccacgttgtcaggacgcggcgcaacaggggtatgccaacgccacggagctggcggattacctggtcgcgaaaggcgtgccgttccgcgaagcgcaccatattgttggcgaagcggtggtagaagctattcgccagggtaagccgctggaagcgttgccgctggccgatttacagaaattcagccgcgtgattggcgacgatgtgtatccgatattgtctttgcagtcgtgtctggataaacgggcggcaaaaggcggcgtttctccgctgcaggtggcgcaggccatcaacgatgcgaaggcgcgcctcgcgttgtaagccttataagcatagcgccatcaggcaatactgcccggccgagcatcagcgacgccgggtttttttacgcaaaaaaaaagcggaccagaggtccgcaaaagttcacgttggctttagttatttcgggttcgagagataccctctgaacgggcggtgtcttcaagggttaaacgagaaaccgctccgttctgtgatgtattattaatcagaaaggttgatagggataatcgttcattgctatgctacctatcgccatgaactatcgtggcgacggaggatgaataatgaatattcgtgatcttgaatatctggtggcgttagccgaacatcgccatttccggcgagcggcggactcctgtcacgtcagccagccaacccttagcgggcaaatacgtaagctggaagatgagctgggcgttatgctgctggagcgtacgagccgtaaggtgctgtttacccaggcgggcttactgctggtggatcaggcgcgtaccgtactgcgtgaggtcaaggtgctcaaggagatggcaagccaacaaggcgagacgatgtccggcccgctgcatattggtttaatcccaacaattggtccctatttgctgccgcttatcattccaatgttgcaccagactttcccgaagctggaaatgtatctgcatgaggcgcaaacgcatcagttgttagcgcaactcgatagcggcaagcttgactgcgctattctggcgctggtgaaagagagcgaggcgtttatcgaagtgccgctgtttgatgagcccatgatgctggctatttatgaggatcatccgtgggcgaatcgcgatcgcgtgccgatgtccgatctggcgggcgagaaattgctgatgctggaagatggccactgtctgcgcgatcaggcgatggggttctgttttgaagcgggagcggatgaagatacccatttccgggcgaccagtctggaaacgctgcgcaacatggtggcggcgggcagtggtattacactactccccgcgctggccgtaccgcaggagcgtaagcgcgacggcgtggtttatctgccatgcattaagccggagccgcgtcgtaccgtggggctggtttatcgcccgggatcgccgctgcgtagccgttatgagcaactggcagaggccatccgtggcgcaatggatggccatttcgacaaggcgttaaaacaggcggtttaagccgttcaacgccgcaacccgataagcttccgccatggttgggtagttaaaggtggtgttaacgaagtattcgatggtgttaccgccacctttctgctccatgatcgcctggccgatatgaataatttcggcggcgcgttcgccaaagcagtgaatccccagaatttctttggtttcgcggtggaagagaatttttagcgtgccgacgttcatgccgacgatttgcgctcgcgccagatgcttaaattgcgcgcggcccacttcgtaaggcactttcattgccgttaactgctgctcggttttgccgacagaactgatttccggaatggtataaatcccggtggggatatcttcgatgagatgcgcggtcgcttcgcctttcaccagcgcctgcgctgcaatacgcccctgatcgtaggcggcggaggccagactgggatagccaatcacgtcgcccaccgcatagacgtgcggcagggcggtctggtacatactgttgactttgagctgtccacggctgtctgtttccagaccaatattctccagcgccagcgaatcggtgttaccggtacggccattagcatagagcaggcagtcagccttcagttttttgccggatttcaggtgcatgatgacgccatcatcgcagccttcgattttctcatactcttcattgtggcgaataaccacgccgctattccagaaatggtaagagagagagtcggacatctcctgatcgagaaaggccagcaggcgatcgcgggtgttgatcagatccactttcacatccataccgcggaagatggacgcatattcgcagccgataacgccggcgccgtaaataataacgtggcgcggttcatggtggagactcaggattgagtcgctgtcataaatgcgcggatgcgagaaatccacatcattgggatggtaaggacgcgaaccacaggcaataacaaatttttctgccgtcagggtttcaaccgtgccgtcatggcattccagcgccagggtatgttcgtcaataaaatgggcgttgccctgcaatatttcacagtggttacgctcataaaacccctgacgcatacgcgtttgttgattaatcacgttatcggcatgattaaggatgtcggcgaaagaagaacgaaggagacgggagtggtcgctatagagcgggttttgattaaattcaataatgcggctgacggcgtggcgaagggctttggatgggatggtgccccagtgggtacatccgccgccaacgttatgataacgctcaatcaccgcgacgcgtgctccttgcttaaccagacccattgcagcgccttcaccgccggggcctgaccctatgacgactgcatcataatcccaggaatgtggcatggtattactcacctgtttttatacataaaataaacacgatgataacatttgcccagctttaacccaattatcgttgtgcttttttgcgaagccggagcacaaactgtctgtaaacaatcattcacaatccagtgtgaacccgttacttttattctctggtatagtgccgaataaggcatatggaaggattcagacattgtgatgggtgttagagcgcaacaaaaagaaaaaacccggcgttcgctggtggaagccgcattcagccaactgagcgctgagcggagttttgccagcctgagtttgcgtgaggtggcgcgtgaagcgggcattgcgccaacgtcgttttaccgtcattttcgcgatgtcgatgaactcggtctgacgatggtggatgaaagcggtctgatgctgcgtcagttgatgcgtcaggcgcgacagcgtatcgcgaaaggcggcagcgtcattcgcacgtcggtctccacatttatggagtttatcggcaacaaccccaacgccttccgtctgttattgcgcgaacgttccggcacttcagcggcgtttcgtgccgccgtcgcacgggagattcagcactttattgcggaacttgccgactatctggaactcgaaaaccatatgccgcgcgcgtttactgaagcccaggccgaagcgatggtaactattgtctttagcgcgggcgcagaggcgttggacatcggcgctgaacagcgtcggcaattagaagagcggctggtattgcaactgcgcatgattgcgaaaggggcgtattactggtatcgccgtgagcaagagaaaatagcacatcattccgaataacgtgaaggacgagtaatgaaacagtcaggtcaagataaaggtacgctgttgctggcgctcatcgctggcttatcgattaacggcacattcgcggcgctgtttagcgctattgtgccgttctccgtattcccgattatctcgctggtgctgacggtatattgcctgcatcagcgctaccaaaatcgtactatgccggtaggtttgccggggttggccgccgcttgtttcattcttggcgttttactgtatagcaccgtcgtgcgtgcagaatatccggatattggctctaatttcttcccggcggtgctgtcggtgattctggtattctggattggctttaaactgcgtaaccgcaagcaggacaccgcggaatagtgtgcgaatgccggatggcggtataaccggccatccgacgtacattttaccttgcggtgagtaataccccgcattccatatgatgtgtatacgggaactgatcgaatagcgccaggcgagacaccgtgtgcgtctggcttaacgtttccaggtttttgcacaacgtttccggattgcaggaaatgtacagaatacgtggataagcctgcaccattttttccgtttcgctgtccagaccgctgcgcggcggatcgacaaaaatggtttcgcactgatagcgcttcaggtcgatcccctgcaggcggttaaactcacgaacgccattcatcgcctgggtaaactcttccgccgccatgcgaataatttgcacattatcaatatgattagcggcaatattgtactgtgcggcagcgacggacggtttggcgatttcggttgccagcacgcggttaaaattgcgcgccagcgctaaagaaaaattgccgttgccgcaatacaactcaagcagatcgccttttgagtctttcgtcacctccagcgcccactctaacatctgaatattcatggcggcgtttggctgcgtaaagctgttttcgacctggcggtagatcatctctttacctgccacaggcagacgctcatcaatataatcctgatccaattcgattttagttttagtggcccggccaatcaggtgtacgttcagaccttgcgcgcgtaaagcatcgcgtaacgcagtggcggcttcacgccactcttcgtccagcttcttatggtacagcaacgacactaccgcctggttgctcaaggtcgtgagataatcgatctggaacagcttatgccgcagtgcatgattatcgcgcacgccggcaatcatcgccttcattaaggtattaatcagttggctggccgccgggaaggtgtcaacgcgaatccggcttttggtctgctgatcaaacataatgtggtacaggtcatcgccgtcatgccacaggcgaaattccgcacgcatacgatagtgactgaccggcgagcgaaatacttccggaaccaggccagaaaacggcgccatcatactctgcaagcgcgccactttttcggccagctgcgcctcatactgttctgtcggaagatgttcgggggtcatatcgcatcctgaataataaaagtacgcggggattgtagggattgctcagtggatgtccagctattgatgatttctgatttgtgatgcgcggtctggacagggtgttgtgacagacggtagcatccgtgggccggtcctgtgagttaatagggaatccagtgaaaatctggagctgacgcgcagcggtaaggaaaggtgagatgagagcgtaagcagacactgcctccggcgggaagtcatcatttctgctatccagccaacggataaccctccaagcccgaagacctgccggctaacgtcgcatctggtttttcatcatcgcgtactatcgatgaagcctgcggcatccttcttatattgtggatgctttacaatgattaaaaaagctacgctgctgacggcgttctccgtcacggccttttccgcttgggcgcaggacactagcccggataccctggttgtcaccgccaaccgttttcagcagccgcgcagcgcggttctggcgcccgttaccatcgtgacgcgtcaggatattgaacgctggcaatcgacctccgtaaatgatgttctgcgccgtttgcctggcgtcgatattgcgcagagcggcggcgccggacaaaactcctccattttcattcgcggcaccaactccagccatgtactggtattgattgacggcgtgcgtctgaatttagcaggcgtgagcgggtccgccgatctcagccagttcccggtgtcgctggtacagcgcattgaatatattcgcggtccgcgctccgctatttatggttccgatgctatcggcggcgtagtgaatatcattacgacgcgcgataacccaggcacagaattaaccgctggatggggaagcaatagctaccagaattacgacatctcgacgcaacagcaacttggcgaaaacacgcgggcgacgttgatcggcgattacgaatacaccaaagggtttgacgtggtagcgaaaggcggtaccgggatgcaggcgcagcctgaccgggacggctttttgagtaaaacgctttatggcgcgttagagcataccttttctgatcgctggagcggattcgtgcgtggttatggctacgataaccgtaccgattacgacgcctattactcgccgggctcgccgctgattgatacacgcaaactttatagccaaagctgggacgccgggctgcactttaatggcgaacgtattcagtctcagctggtttcaagctatagccacagtaaagattacaactatgatccgcactatggccggtatgatacctccgccacgctggatgagatgaaacagtacaatgttcaatggaccaacagtgtggtcgtggggcacggtaatgttggggcgggcgtagactggcagaaacagactaccacgccaggtaccggctatgtgcccgagggatatgaccagcgtaataccggggtttacctgacaggattacaacagttgggtgacttcactctggaagcggcggcgcgcagtgatgacaactcccagtttggtcgtcatggtacatggcaaaccagcgcgggatgggagtttatagaaggttatcgctttattgcctcctacggaacctcctacaaagcgcctaatttgggccaactgtatggttattacggtaatccgaacctgaatcctgaaaagagtaaacagtgggaaggcgcatttgaagggctaaccgctggcgtcagctggcgtatttcaggttatcgtaacgatattaatgacatgatcgattatgacgatcatctgcaaaaatattacaacgaaggtaaggcgcgcattaaaggtattgaggcgacggcgaatttcgataccggaccgttaacgcatacggtcagttatgattacgttgatgcgcgtaatgcgattaccgatacgccattaccccggcgttccaaacagatggcaaaatatcaacttgactgggacgtttacgattttgactgggggatgacatatcaataccttggttcccgctatgattcggattactccgcttacccataccggacagtaaaaatgggcggcgtcagtttatgggatcttacggttgcatatccggtcacctcacatctgacagttcgtggtaaaatagccaacctgttcgacaaagattacgagacagtttatggctaccaaactgcaggacgagaatacaccttgtctggcagctacaccttctgaaccacgtcccaccgtgctggtatttgattccggcgtcggtggattgtcggtctatgatgagattcggcggctcctgccggatctccactatatatatgctttcgataacgtggctttcccctacggggaaaagagtgaaacgtttatcgtcgagcgcgttgtcgagattgtgactgcggtacagcagcgctatcccctttcactggcggtgattgcctgtaataccgccagtacggtctcacttcccgcattacgtgaaaagtttgccttcccggtggtgggcgttgtgcctgcgattaaaccagcggcgcggctgaccgcaaatggcgtcgtcgggctactggcgacgagagccacggtcaaacgtccttatactcacgagctgattgcgcgcttcgccaatgaatgtcagatagcgatgttagggtcggcagaactggtggaactggcggaagctaaattacatggcgattcggtatcgctggaagaactgcgccgcatattacgcccatggctacgaatgccggagccgcctgacacggtcgttctggggtgtacgcatttccctctattacgggacgagcttttgcaagtcctgcccgaagggacgcggttagtggattccggcgcggcgatagcgcgtcgtacagcctggctgttggaacatgaagcgccggatgcgaaatcaaccgatgccaatattgcttattgcatggcaatgacgccaggagctgaacaattattacccgttttacagcgttatggctttgaaacgctcgaaaaactgccggtttaatggcgttttgggtaaataccaggcacttgagaaattattttaaatttcctcttgtcaggcagaaataactccctataatgcgccaccactgacacggaacaacggcacacaggccgccgggtcaccggggttcagaccagaacctcacggagaaaagcgaaaataaacgcttgactctgaagcgggaaagcgtaatatgcacaccccgcgccgctgagaaaaagcgaagcggcactgctctttaacaatttatcagacaatctgtgtgggcactcgaagatacggattcttaacgtcctaggacgaaaaatgaataccaagtctcaagagtgaacacgtaattcattacgaagtttaattcattgagcatcaaacttttaaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacagaagaatccagagatggatttgtgccttcgggaactgtgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaaacggtctttgaagtgctcacacagattgtctgatgaaaaacgagcagtaaaacctctacaggcttgtagctcaggtggttagagcgcacccctgataagggtgaggtcggtggttcaagtccactcaggcctaccaaattttccctgaatactgcgttgtgaaataactcacatactgatgtatgcttcgttattccacgccttgtctcaggaaaaattatcggtaaagaggttctgactacacgatggggctatagctcagctgggagagcgcctgctttgcacgcaggaggtctgcggttcgatcccgcatagctccaccatctcgtgagtgtttacgaaaaaatacttcagagtgtacctgaaagggttcactgcgaagttttgctctttaaaaatctggatcaagctgaaaattgaaacacagaacaacgaaagttgttcgtgagtctctcaaattttcgcaacacgatgatgaatcgtaagaaacatcttcgggttgtgaggttaagcgactaagcgtacacggtggatgccctggcagtcagaggcgatgaaggacgtgctaatctgcgataagcgccggtaaggtgatatgaaccgttataaccggcgatttccgaatggggaaacccagtgtgattcgtcacactatcattaactgaatccataggttaatgaggcgaaccgggggaactgaaacatctaagtaccccgaggaaaagaaatcaaccgagattcccccagtagcggcgagcgaacggggaggagcccagagcctgaatcagcatgtgtgttagtggaagcgtctggaaaggcgcgcgatacagggtgacagccccgtacacaaaagcgcatgtgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacaggtttacctgtgtgactgcgtaccttttgtataatgggtcagcgacttatattctgtagcaaggttaaccgtataggggagccgtagggaaaccgagtcttaaccgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaattcatctccgggggtagagcactgtttcggctagggggccatcccggcttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgaacgtatcacccaagacaactttacggagttgacgattgacggagcgaagcgacgtcaaagcgttcattaaagtcgagttggcttagggatacgttcgttgggtaggggagcgttctgtaagcctgtgaaggtgtgtcgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacgggttaatattcccgtacttggtgttactgcgaaggggggacggagaaggctatgttggccgggcgacggttgtcccggtttaagcgtgtaggtgtgtgttccaggtaaatccggttcactttaacactgaggcgtgacgacgaggcactacggtgctgaagcaacaaatgccctgcttccaggaaaagcctctaagcatcaggtaacacgaaatcgtaccccaaaccgacacaggtggtcaggtagagaataccaaggcgcttgagagaactcgggtgaaggaactaggcaaaatggtgccgtaacttcgggagaaggcacgctgacacgtaggtgaagtgatttactcatggagctgaagtcagtcgaagataccagctggctgcaactgtttattaaaaacacagcactgtgcaaacacgaaagtggacgtatacggtgtgacgcctgcccggtgccggaaggttaattgatggggtcagcgcaagcgaagctcctgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgtggacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagatgttttggcggttaagagaagattttcagcactgattcagagttgagtacgcaataatttgcgcagcagcgaggcggcaagcgaaggaaaggaaggagcatacagaagtatgtgactgactttacgagcgcaggcaacgccgctgatgcgataaagaattgcgtacagagcacaaagaatttgcctggcggcactagcgcggtggtcccacctgaccccatgccgaactcagaagtgaaacgccgtagcgccgatggtagtgtggggtctccccatgcgagagtagggaactgccaggcatcaaataaaacgaaaggccctgtcggaagacagggccttttgtttttgtctgtttctgccggatggcggctccgccttatccggcctacagggacgcgccgatctaccctcattataaccacaagccttcccaacacagatacggtaaactattgccgattgagtatcaggaaagcagccatgacccactccctaaaaccctggaataccttcggcattgatcattgtgcaaagcacatcgtatgcgctgaaaacgaacaacaactactgagcgcctggcagcaagcaactcgtgagggactgccggttatgatcctgggtgaaggaagcaatgtcctgtttctggaaaattacgccggcaccgtgatccttaaccgcctgaaaggcattgaggtcaatgaaaccgcggacgcctggcacctacacgtcggcgcaggcgaaaactggcatcagctggttcgctacgcgctggacaacaacatgcccggcctggagaatctggcgctcatccctggctgcgttggttcctcgcctatacagaatattggcgcgtatggcgtagaactacagcgcgtctgcgactacgttgactgcgttgaactggaaacgggaaaacgtctgcgtttgtccgcggcggaatgccgtttcggctatcgtgacagtatcttcaaaaatgaatatcaggatcgcgttgcgatcgtcgcggtgggtctgcgtttgtcaaagcaatggcagccggtgttgacctatggcgatcttacttgtttggacccgaaaacggtcaccgcgcaacaggtgtttgatgctgtatgccatatgcgcaccacaaaattgccggatcctaaagtgaatggcaatgcgggcagcttttttaaaaatcccgttgtcgcagccgatatcgctatggaactgttagaacgatttcccaacgcgccgcattaccctcaggcagacggctcagtgaagctggcggcaggctggctgatagatcaatgtcagttgaaaggcgtcaccattggcggcgctgcggtgcatcgccaacaggcgctggtattgattaatgcgaatgatgcgacaagtaaagatgtggtggcgctggcgcatcatgtccggcaaaaagtgggtgaaaaatttaatgtctggctggagcctgaggttcgctttattggtcggtccggagaggtgaacgctgtggagagcattgcatgaaagatactaccgttcccctgacgctgatctcactacttgccgacggagagtttcactcaggcgagcagttgggtgaacggctgggaatgagccgcgcggctattaataaacatatccagacattacgcgactggggagtagatgtatttaccgttcccgggaaaggatatagcttaccggaacccatccagttactggatgctgaccgtatacatagccaactggatagcggaaacgtggcggtattgcccgttatcgattcaaccaatcagtatttacttgatcgaattggcgagctgcgctcaggcgatgcctgtgtagcagaataccaacaggcggggcgtggtcgtcgcgggcgtaaatggttctcaccgtttggcgcgaatctatatctttcaatgtactggcgtctggagcagggccctgcggcggcaataggcctgagtctggtcattggaattgtgatggcggaagtgctgcgtaaactgggcgcagataaagttcgtgtgaagtggcctaacgacctttacctactggaccgcaaactggcgggtattctggtcgagttaaccggtaaaacgggcgatgccgcacaaatagtgattggcgctggtattaacatggcaatgcgtcgcgtagaagaggacgtgataaatcagggatggatcacactacaagaggccggaattacgctcgaccgcaatatgctggccgcaaagctgatttataagctacgtgctgcgcttgagctttttgagcaagaaggtctttctccttatctttcgcgctggaaaaaactggataattttattgatcgcccggtaaaactaattattggtgacaaagaaatatttggtatttctcgcggcattgatactcaaggcgcattattgcttgaacaggatggcgtgattaaaccctggatgggcggagaaatatcgctgcgaagcgccgaatagtaaaaagggggagtcggtactccccttttttctgttatttccgcaatcttacctgttccaccgcatggttagcgctcttggtcataataaggctggcacgttctcgtgtaggtaagatattttgttttaaattcaaccagttaatttctttccaaagcgaagttgctgtattaacagcttcttctttagataatttcgcataattgtggaaataagagtcaggatcggtaaacgccccttcgcggaatttcaggaagcgattgatataccacgtctgaagaagttcttctggcgcatccacgtaaatagagaaatcaacgaaatcagagacaaatacatgatgcggatcgtgaggataatccataccgctttgtaaaacattcaaaccttcaagaatcaatatatcaggctgagcgacggttttatccccttcaggaataacatcgtaaatcaaatgagaatagactggcgccgtcacgttcggtacgcccgacttgaggtcagaaacgaatttcaccagtcggtgcatatcatacgattcggggaacccctttttcttcattaacccgcgttctttcaacacctggtttgggtggaggaagccgtctgtggtaatcaattcaacacggcggtgttccggccagcgactcagcaacgcttgcagaacgcgtgctgtcgtgcttttacccactgcgacgctgcccgcgatactgatgatgtaagggattcgctggccgttagtgcccagaaactgttccaggacagcctgacgacgcagatttgaactgatatagaaatttagcaaacgggagagaggtaaatatatttctgcaacttcttccagcgataaatcttcattaatgccttttaactgcgcgatctcatcctcggtcagggtcatcggcacagaatcgcgaagcgcagcccactggctgcgatcaaactgtaggtaaggcgtcattaacgattgctcttttatactcataagcatgtttctggctgctattgctacatcagttcagcgatgaacgagggccatccctgacatgcaacggcacgtcacatttaagttaatttggacaatgggcaggagggtaacaccagatggggaggaataataagaaaaaatctcgctgtgaaagctatccctgagaagcaatgtgacgaatataccagatacagaagattgctttctatcgacggagcgttgaaatgccgcgtcgtatcctggtcagacggtcggtaaaatgccgaaaatttatgctctcttgtttgaaattagagcatttttgtctcttatagcgcaaaatgtgagcgatagaacattttatgcaattttttagttgcatgagcacgcaggtctccatagaatgcgcgctacttgatgccgacttagctcagtaggtagagcaactgacttgtaatcagtaggtcaccagttcgattccggtagtcggcaccatcaagtccggtggggttcccgagcggccaaagggagcagactgtaaatctgccgtcacagacttcgaaggttcgaatccttcccccaccaccattttcggccgcgcgatggcgcagcccgagacgataagttcgcttaccggctcgaataaagagagtttctctcgatattcagtgcagaatgaaaatcaggtagccgagttccaggatgcgggcatcgtataatggctattacctcagccttccaagctgatgatgcgggttcgattcccgctgcccgctccaagatgtgctgatatagctcagttggtagagcgcacccttggtaagggtgaggtcggcagttcgaatctgcctatcagcaccacttcttttctccttcctgtttttctcttctgtttattagcattcaacaagtcgggcgtgttgcctggttgatgtggtgatatcaccgatttatccgtgtcttagagggacaatcgatgtctaaagaaaagtttgaacgtacaaaaccgcacgttaacgtcggtactatcggccacgttgaccatggtaaaacaacgctgaccgctgccattactaccgtactggctaaaacctacggcggtgccgctcgcgcattcgaccagatcgataacgcgccggaagaaaaagcgcgtggtatcaccatcaacacttctcacgttgaatacgataccccgacccgccactacgcacacgtagactgcccggggcacgccgactatgttaaaaacatgatcaccggtgctgctcagatggacggcgcgatcctggttgttgctgcgactgacggtccgatgccgcagacccgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacacgccgatcgttcgtggttctgctctgaaagcgctggaaggcgacgcagagtgggaagcgaaaatcatcgaactggctggcttcctggattcttacatcccggaaccagagcgtgcgattgacaagccgttcctgctgccgatcgaagacgtattctccatctccggtcgtggtaccgttgttaccggtcgtgtagaacgcggtatcatcaaagtgggcgaagaagttgaaatcgttggtatcaaagagactcagaagtctacctgtactggcgttgaaatgttccgcaaactgctggacgaaggccgtgccggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggcaccatcgaactgccggaaggcgtagagatggtaatgccgggcgacaacatcaaaatggttgttaccctgatccacccgatcgcgatggacgacggtctgcgtttcgcaatccgtgaaggcggccgtaccgttggcgcgggcgttgttgctaaagttctcggctaatcgctgataacatttgacgcaatgcgcaataaaagggcatcatttgatgccctttttgcacgctttcacaccagaacctggctcatcagtgattttatttgtcataatcattgctgagacaggctctgtagagggcgtataatccgaaaggcgaataagcgtttcgatttggattgcctcgcgattgcggggtgaaaatgtttgtagaatacttctgacaggttggtttatgagtgcgaataccgaagctcaagggagcgggcgcggcctggaagcgatgaagtggatagttgttgccatattgctgatcgtcgcaatcgtcggcaactacctctatcgcgacatgatgctgccgctgcgtgcgctggccgtagtaattctgattgctgcagcgggtggtgtcgcgctgttgacgacaaaaggtaaagcaaccgttgcttttgcccgtgaagcgagaaccgaagtccgtaaggtcatttggccgactcgccaggaaacgctgcacaccacgctgatcgtcgctgcggttaccgcagttatgtcactgatcctgtggggactggatggtattctggttcgcctggtatcctttatcactggcctgaggttctgagatgtctgaagcacctaaaaagcgctggtacgtcgttcaggcgttttccggttttgaaggccgcgtagccacatcgctgcgcgagcatatcaaattacacaatatggaagagctgtttggcgaagtcatggtgccgactgaagaagtcgttgagatccgtggcggccagcgtcgcaaaagcgaacgcaaattcttcccgggttacgttctggtccagatggtcatgaacgacgcaagctggcacctggtgcgcagcgtgccgcgtgtgatgggctttatcggcggtacctctgaccgtccggcgccgatcagcgacaaagaagtcgatgcgatcatgaaccgcctgcagcaggttggcgataagccgcggccgaaaactctgtttgaaccgggtgaaatggttcgtgttaacgacggtccgttcgcagactttaacggcgttgtcgaagaagtcgattatgagaagtctcgcctgaaagtgtctgtttctatcttcggtcgtgcgaccccggtagagctggacttcagtcaggttgagaaagcgtaaggctgcgatcaaaaaagcagcgatctaatcgttgcatagggcgcgaaattgacatacaatttcgcgccttttgtttttatgggccttatgcccataaagcgatatttatcacggggagcttctttgaagcgatactacccaattcgaggaatttagaatggctaagaaagtacaagcctacgtcaagctgcaggttgcagctggtatggcgaacccgagtccgccggttggtccagcactgggtcagcagggtgtgaacatcatggaattctgcaaagcgttcaacgcaaaaacggattccatcgaaaaaggtctgccgattccggttgttattaccgtttacgctgaccgttctttcaccttcgttaccaaaacgcctccggcagctgttctgctgaaaaaagcggctggtatcaagtctggttccggcaagccgaacaaagacaaagtaggtaaaatttcccgcgctcagctgcaggaaatcgcgcagaccaaagctgccgacatgaccggtgccgacattgaagcgatgactcgctccatcgaaggtactgcacgttccatgggcctggtagtggaggactaagaaatggctaaactgaccaagcgtatgcgcgtgatccgtgaaaaagttgatgcgaccaaacagtacgacatcaacgaagctattgccctgctgaaagagctggccactgctaaattcaacgaaagcgttgacgttgccgttaacctcggcatcgacgctcgtaaatctgaccagaacgttcgtggcgcgactgtactgccgcacggtactggccgttctgttcgcgttgccgtatttacccaaggcccgaacgctgaagcagctaaagctgctggcgctgagctggtaggtatggaagatctggctgaccagatcaagaaaggcgaaatgaacttcgacgttgttatcgcatccccggatgcaatgcgcgttgttggccagctgggccaggttctgggtccgcgcggcctgatgccaaacccgaaagtcggtaccgtaactccgaacgttgctgaagcggttaagaacgctaaagcaggtcaggttcgttaccgtaacgacaaaaacggcatcatccacaccaccatcggtaaagtggactttgacgctgacaaactgaaagaaaacctggaagctctgctggttgcgctgaaaaaagcaaaaccgagccaggcgaaaggcgtgtacatcaagaaagttagcatctccaccaccatgggtgctggcgttgccgttgatcaggctggtctgagcgcatctgcgaactaagattagtctttacgtgggcggtgattttgtctacaatcttacccccacgattctgttgaaatataacagagcactatgcgagtcatttgaattgcagcaaggcagcaagtgagtgagtcgccaggagcatagttaactatgtgactggtgtgaacgagcgcagctaacacagctgcggttcaaaggacgaagtcatagaaagaatttgttcgttggagcctggcctatccaggcctccgtcgaagaccgcaggcgtctcgcaagaggcttaatcccctgcgtagacggtgacagaacgctaagattattttttatactctggcttgtttctgctcaccgtattaagacgctcttctcgttgagatgagtgaagtgagttccggaacatgagttccggcaaacatccaggagcaaagctaatggctttaaatcttcaagacaaacaagcgattgttgctgaagtcagcgaagtagccaaaggcgcgctgtctgcagtagttgcggattcccgtggcgtaactgtagataaaatgactgaactgcgtaaagcaggtcgtgaagctggcgtatacatgcgtgttgttcgtaacaccctgctgcgccgcgtcgttgaaggtactcagttcgagtgcctgaaagacacgtttgttggtccgaccctgattgcatactctatggaacacccgggcgctgctgctcgtctgttcaaagagttcgcgaaagcgaatgcaaaatttgaggtcaaagctgcagcctttgaaggtgagctgatcccggcgtctcagatcgaccgcctggcaactctgccgacctacgaagaagcaattgcacgcctgatggcaaccatgaaagaagcttcggctggcaaactggttcgcacactggctgctgtacgcgatgcaaaagaagctgcgtaatcgcagttgtctttatcaagcatttgcttacgtataaacttattctgatattcaggaacaatttaaatgtctatcactaaagatcaaatcattgaagcagtatccgctatgtccgtaatggacgttgtagaactgatttctgcaatggaagaaaaattcggtgtttccgctgctgctgctgtagctgtagctgctggcccggctgaagctgctgaagaaaaaactgaattcgacgtaattctgaaagctgctggcgctaacaaagttgctgttatcaaagcagtacgtggcgcaactggcctgggtctgaaagaagctaaagacctggtagaatctgctccggccgctctgaaagaaggcgtgagcaaagatgacgctgaagcactgaaaaaatctctggaagaagctggcgctgaagttgaagttaaataagccaacccttccggttgcagcctgagaaatcaggctgatggctggtgactttttagtcaccagcctttttgcgctgtaaggcgccagtagcgtttcacactgtttgactactgctgtgcctttcaatgcttgtttctatcgacgacttaatatactgcgacagagcgtacgttctgtgtaaatcgcaatgaaatggtttaagcgtgatagcaacaggcattgcggaaagtatccattttccggtcaacaaaatagtgttgcacaaactgtcccccgcaggacagatgggtcgacttgtcagcgagctgaggaaccctatggtttactcctataccgagaaaaaacgtattcgtaaggattttggtaaacgtccacaagttctggatgtaccttatctcctttctatccagcttgactcgtttcagaagtttatcgagcaagatcctgaagggcagtacggcctggaagcagccttccgttccgtgttcccgattcagagctacagcggtaattccgagctgcagtacgtcagctaccgccttggcgaaccggtgtttgacgttcaggaatgtcagatccgtggcgtgacctattccgcaccgctgcgcgtaaaactgcgtctggtgatctacgagcgcgaagcgccggaaggcaccgtaaaagacattaaagaacaagaagtctacatgggcgaaattccgctcatgaccgacaacggtacctttgttatcaacggtactgagcgtgttatcgtttctcagctgcaccgtagccctggcgtcttctttgactccgacaaaggtaaaacccactcttcgggtaaagtgctgtataacgcgcgcatcattccttaccgtggttcctggctggacttcgaattcgatccgaaggacaacctgttcgtacgtatcgaccgtcgccgtaaactacctgcgaccatcatcctgcgtgcgctgaactacaccactgagcagatccttgacctgttctttgagaaagtcgtcttcgaaattcgcgacaacaaactgcagatggagctgattccagaacgtctgcgtggcgaaaccgcgtcgttcgatatcgaagctaacggcaaagtgtacgttgaaaaaggccgtcgcattaccgcgcgtcacatccgtcagctggaaaaagacgatatcaagcatatcgaagttccggttgagtacatcgcaggtaaagtcgtctctaaagactacgttgacgaatctactggcgagctgatctgcgcggcgaacatggagctgagcctggatctgctggctaagctgagccagtccggccacaagcgtatcgaaacgctgtttaccaacgatctggaccacggcccgtacatttctgaaacggtacgcgtcgacccaactaacgatcgtctgagcgcgctggtagaaatctaccgcatgatgcgccctggtgagccgccgacacgcgaagcggctgaaagcctgtttgagaacctgttcttctccgaagaccgctatgacctgtctgcggtgggtcgtatgaagttcaaccgttctctgctgcgcgacgaaatcgaaggttccggtatcctgagcaaagacgacatcattgatgtcatgaagaagctcatcgatatccgtaacggtaaaggcgaagtggatgatatcgaccacctcggcaaccgtcgtatccgttccgtcggcgaaatggcggaaaaccagttccgcgttggcctggtgcgtgtagagcgtgcggtgaaagagcgtctgtctctgggcgatctggataccctgatgcctcaggatatgatcaacgccaagccgatttccgccgcagtgaaagagttctttggttccagccagctgtctcagtttatggaccagaacaacccgctgtctgagattacgcacaaacgtcgtatctccgcactcggcccaggcggtctgacccgcgaacgcgcaggcttcgaagttcgagacgtacacccgacgcactacggtcgcgtatgtcctatcgaaacgccggaaggtccgaacatcggtctgatcaactccctgtccgtgtacgcacagactaacgaatatggcttccttgagacgccgtaccgtcgtgtggttgatggcgtggttactgacgaaattcattacctgtctgctatcgaagaaggcaactacgttatcgctcaggcgaactccaacctggatgacgaaggccactttgtagaagatttggtgacctgccgtagcaaaggcgaatccagcttgttcagccgcgaccaggttgactacatggacgtttccacccagcaggtggtctccgtcggtgcgtccctgatcccgttcctggaacacgatgacgccaaccgtgcattgatgggtgcgaacatgcaacgtcaggcggttccgactctgcgcgctgacaagccgctggtgggtaccggtatggaacgtgctgtcgccgtcgactccggtgttactgcagtagctaaacgtggcggtactgttcagtacgtggatgcgtcccgtatcgttatcaaagttaacgaagacgagatgtacccgggcgaagcgggtatcgacatctataacctgaccaaatacacccgctctaaccagaacacctgtatcaaccagatgccatgtgtgtctctgggcgagccggttgaacgcggcgacgtgctggcagacggtccgtccaccgacctcggtgaactggcgctcggtcagaacatgcgcgtggcgttcatgccgtggaacggctacaacttcgaagactccattctcgtttccgagcgtgttgtccaggaagaccgtttcaccaccatccacattcaggaactggcgtgcgtgtcccgtgacaccaagctggggccggaagagatcaccgctgatatcccgaacgtgggtgaagctgcgctctccaaactggatgaatccggtatcgtttacatcggcgcggaagtgacaggcggtgacattctggtcggtaaggtgacgccgaaaggtgaaacccagctgacgccggaagagaaactgctgcgtgcgatcttcggtgagaaagcgtctgacgttaaagactcttctctgcgcgtacctaacggtgtctccggtacggttatcgacgttcaggtctttactcgcgatggcgtagaaaaagacaaacgtgctctggaaatcgaagagatgcagctcaagcaggcgaaaaaagacctgtctgaagaactgcagatcctcgaagcgggcctgtttagccgtatccgtgcggtgctggtttccagcggcgttgaagctgagaagctcgacaaactgccgcgcgaccgctggctggaactcggtctgaccgacgaagagaaacaaaatcagctggaacaactggctgagcagtatgacgaactgaaacacgagttcgagaaaaaacttgaagcgaagcgccgtaaaatcacccagggcgacgatctggcgccgggcgtgctgaagatcgtgaaggtctatctggccgttaaacgccgtatccagccgggtgataagatggcaggtcgtcacggtaacaagggtgttatctctaagatcaacccgatcgaagacatgccttacgatgaaaacggcacgccggtagacatcgtactgaacccgctgggcgtaccgtctcgtatgaacatcggccagattctggaaacccacctgggtatggctgcgaaaggtattggcgacaagattaacgccatgctgaaacagcagcaggaagtcgcgaaactgcgcgaattcatccagcgtgcctacgatctgggcgccgacgttcgtcagaaagtcgacctgagcaccttcagcgatgatgaagtgctgcgtctggcagaaaacctgcgcaaaggtatgccgattgccacaccagtgtttgacggtgcgaaagaagcggaaatcaaagagctgctgaaactgggcgacctgccgacctccggtcagatcaccctgttcgatggccgtacgggtgaacagttcgaacgtccggtaaccgtcggttacatgtacatgctgaaactgaaccacctggttgatgacaagatgcatgcgcgttctaccggttcttacagcctggttactcagcagccgctgggtggtaaggcgcagttcggtggtcagcgcttcggggagatggaagtgtgggcgctggaagcttacggcgccgcctacaccctgcaggaaatgctcaccgttaagtctgatgacgtgaatggtcgtaccaagatgtataagaacatcgtggacggcaaccatcagatggaaccgggtatgccggaatccttcaacgttctgttgaaagagatccgctcgctgggcatcaacatcgaactggaagacgagtaattctcgctcaaacaggtcactggtgtcggggtaaaacccgacaccagattgtgctaactccgacgggagcaaatccgtgaaagatttattaaagtttctgaaagcgcagactaaaaccgaagagtttgatgcgatcaaaattgctctggcttcgccagacatgatccgttcatggtctttcggtgaagttaaaaagccggaaaccatcaactaccgtacgttcaaacctgagcgtgacggccttttctgcgcccgtatctttgggccggtaaaagactacgagtgcctgtgcggtaagtacaagcgcctgaaacatcgtggtgttatttgtgagaagtgcggcgttgaagtgacccagaccaaagtacgccgtgagcgtatgggccacatcgagctagcgtccccgactgctcacatctggttcctgaaatcgctgccgtcccgtatcggtctgctgctcgatatgccgctgcgcgatatcgaacgcgtactgtacttcgaatcttatgtggttatcgaaggcggtatgaccaacctggaacgtcaacagatcctgactgaagagcagtatctggacgcgctggaagagttcggtgacgaattcgacgcgaagatgggggcggaagctatccaggccctgctgaagagcatggatctggagcaagagtgtgaaactctgcgcgaagagctgaacgaaaccaactccgaaaccaagcgtaaaaagctgaccaagcgtatcaaactgctggaagccttcgttcagtctggcaacaagccagagtggatgatcctgaccgttctgccggttctgccgccagatctgcgtccgctggttccgctggatggtggtcgtttcgccacgtcagatctgaacgatctgtatcgtcgcgtcattaaccgtaacaaccgtctgaagcgtctgctggatctggctgcgccggacatcatcgtacgcaacgaaaaacgtatgctgcaggaagcggttgacgccctgttggataacggtcgtcgcggtcgtgcgatcaccggttctaacaagcgtcctctgaaatctttggccgacatgatcaaaggtaagcagggtcgtttccgtcagaacctgctcggtaagcgtgttgactactccggtcgttctgtaatcaccgtaggtccatacctgcgtctgcaccagtgcggtctgccgaagaaaatggcgctggagctgttcaaaccgttcatctacggcaagctggaactgcgtggccttgccaccaccatcaaagccgcgaagaaaatggttgagcgtgaagaagctgtcgtttgggatatccttgacgaagttatccgcgaacacccggtactgctgaaccgtgcaccgactctgcaccgtctgggtatccaggcatttgaaccggtactgatcgaaggtaaagctatccagctgcacccgctggtttgtgcggcatataacgccgacttcgatggtgaccagatggctgttcacgtaccgctgacgctggaagcccagcttgaagcgcgtgcgctgatgatgtctaccaacaacatcctgtctccggcgaacggcgaacctatcatcgttccgtctcaggacgtggtattgggtctgtactacatgacccgtgactgtgttaacgccaaaggcgaaggcatggtgctgactggcccgaaagaagctgagcgtatctatcgcgcaggtctggcctctctgcatgcgcgcgttaaagtgcgtatcactgaatatgaaaaagatgaaaacggcgaattcgttgcgcacaccagcctgaaagacacgaccgttggtcgcgccattctgtggatgatcgtaccgaaaggtctgcctttctccatcgtcaaccaggcgctgggcaagaaagcgatctccaaaatgctgaacacttgctaccgtattctgggcctgaaaccgaccgttatttttgcggaccagacgatgtacaccggctttgcttatgcagcgcgttcaggtgcgtccgttggtattgatgacatggtcatcccggagaaaaaacacgagatcatctctgaggcggaagctgaagttgctgagatccaggagcagttccagtctggtctggtaaccgctggcgaacgctataacaaagttatcgatatctgggctgcggcgaacgatcgtgtatctaaagcgatgatggataacctgcaaaccgaaaccgtgattaaccgtgacggccaggaagagcagcaggtttccttcaacagcatctacatgatggccgactccggtgcgcgtggttctgcggcacagattcgtcagcttgctggtatgcgtggtctgatggcgaagccggatggctccatcatcgaaacgccaatcaccgcgaacttccgtgaaggtctgaacgtactccagtacttcatctccacccacggtgcgcgtaaaggtctggcggataccgcactgaaaaccgcgaactccggttacctgactcgtcgtctggttgacgtcgcgcaggatctggtagtgaccgaagatgactgtggtacgcacgaaggtatcctgatgaccccggttatcgagggtggcgacgtgaaagagccgctgcgtgaccgcgttctgggtcgtgtgacggcggaagatgtgctgaaaccgggtaccgcggacattctggttccacgcaacacgctgctgcacgaacagtggtgtgacctgctggaagcaaactccgttgacgccgttaaagtgcgttctgttgtatcctgcgacaccgactttggtgtatgtgcgcactgctatggccgtgacctggcgcgtggccacatcatcaacaaaggtgaagctatcggcgttatcgcggcacagtccatcggtgaaccgggtacacagctgacgatgcgtacgttccacatcggtggtgcggcatcgcgtgcggctgctgaatccagcatccaggttaagaacaaaggtagcatcaagctcagcaacgtgaagtcggttgtgaactccagcggtaaactggttatcacttctcgtaacaccgaactgaagctgatcgacgaattcggtcgtaccaaagagagctataaagtgccttatggcgctgtcatggcgaaaggtgatggcgagcaggttgccggcggcgaaaccgtggcaaactgggacccgcacaccatgccggttatcaccgaagtgagtggtttcatccgcttcactgacatgatcgacggtcagaccattacgcgtcagaccgacgaactgaccggtttgtcttcgctggtggttctggattcggctgaacgtactaccggtggtaaagatctgcgtccggcgctgaaaatcgttgatgctcagggtaatgacgttctgatcccgggtaccgatatgcctgcgcagtacttcctgccgggtaaagcgattgtacagctggaagatggcgtacagatcagttctggtgacaccctggcgcgtattcctcaggaatccggcggtaccaaggatatcaccggtggtctgccgcgcgttgcggacctgttcgaagcgcgtcgtccgaaagaaccggccattctggcggaaatcgcaggtatcgtttccttcggtaaagaaaccaaaggcaaacgtcgtctggtgattacgccggttgatggtagcgatccgtacgaagagatgattccgaaatggcgtcagctcaacgtgttcgaaggggaacgtgtagaacgtggtgatgtgatttccgacggtccggaagcgccgcacgatattctgcgtctgcgtggtgttcatgctgtgacgcgttacatcgttaacgaagtccaggatgtataccgtctgcagggcgttaagattaacgataaacacatcgaagttatcgttcgtcagatgctgcgtaaagcgaccatcgaaagcgccggtagttccgacttcctggaaggcgaacaggttgaatattcccgcgtcaagatcgctaaccgcgagctggaagcgaacggcaaagtgggggctaccttctcccgcgatctgctgggtatcaccaaagcgtctctggcaaccgaatcgttcatctctgccgcatcgttccaggagaccacgcgtgtcctgaccgaagcagccgttgcgggtaaacgcgacgaactgcgcggcctgaaagagaacgttatcgtggggcgtctgatcccggcgggtaccggttatgcgtaccaccaggatcgtatgcgccgtcgcgccgcgggcgagcagccagcaacaccgcaggtcactgcggaagatgcatctgcaagcctggcagaactgctgaacgcaggtctgggcggttctgataacgagtaatcgttaaatggtggaggggtatttatccctccaccagcttcatgctggataccgaattccgggtcgcttgcctacaaggaaagaaaatgccagcgattatttcattaatctatttaatgtttagtcttttagtatttacaaaaaagataaccatttcaaacgttctgtccgcttttttattgtttctatcgttatatatacttcaccataaatcattacttatatttatttattgtcttattattattgtcgccaccgctattcttcatcgagtcaaaaccagcgcggataaaaaagccgtattttatttttcaatgccatgctggctcttggttttatctgtaattataaatattaatgaataaatgaattattttttcatgactcttgtttctcgtattattggtgaaaaatcattatcactggttatatgaataaattgtccagtttttgtattatattttgccatcgcacagggaagactattaccaccgttagccataacaaattttgcttttgtattacgataaagattgacgccaggaatggggtcttgaccgaatgtataaggcgttgggacaattacattatgtttgtttgagagccactttactaaaatcccgccaacgccatcaaccggcgtaataaaagtagagaatccacaatactcaaaattgaaattttttatcattgggtttgtttttttctgtaacattgattccaaatgtgactttaaatttatcccataaatctaagttattaaagtctattggctcgccattataaaatacctgctgttcatacattaaatgataaacctgttttattgattgtttacgcgggacattttaaattattaaatgaaggatttaattccattaaggtctttgtttgctcttattacaggaattataaatatgatgccatttctggaataaaagtaaagttaataaattatttatttaattgctcactggtagggtatttatgtatcctccggttaatgcttagtttagcatcttttagctgacagcgattgcaacgctaaaaaacatgtgctaataatcatcatgtaaaatatgtaatgaagtaagtatggagcatttaattgttatgatcccaccattaaatagatatgttcccgcgctttcaaaaaatgaattggttaaaactgttaccaacagggacattcagtttacaagttttaatggaaaagattatcccttgtgctttttagatgagaaaacccctcttcttttccagtggtttgagcggaatcctgctcgctttgggaaaaatgatatacctataattaacacagagaaaaacccctaccttaacaatatcattaaagcagcaacaattgaaaaagaacgtcttataggtatttttgtagatggtgatttttttccgggacaaaaggatgctttttcaaaacttgagtatgactatgaaaacataaaagtcatatatagaaatgatattgactttagtatgtacgataaaaaattatcagaaatttatatggaaaatatttctaagcaagagtccatgccagaagaaaaaagggattgtcatttactgcagctattgaaaaaagaattgagtgatattcaagagggtaatgattcattaattaaatcttacttactggataaaggccatggatggtttgatttttacaggaatatggctatgttaaaggctggtcagttatttttggaggcggataaggttgggtgttatgatttatcaacaaatagtgggtgtatatatcttgatgctgatatgattatcacggaaaaactggggggtatatatattccggatggaatcgctgttcatgtagaaaggatagatggccgtgcttctatggaaaacgggataatagctgttgatcgcaataaccacccggctttacttgctggattagaaataatgcatactaaatttgatgctgatccctattctgatggtgtatgtaatggaattagaaaacattttaattattctttaaatgaagattataattctttttgcgattttattgagtttaagcatgataacattataatgaataccagtcagtttacgcaaagttcatgggcgaggcatgtgcagtagcggaaatggcaataatcatgctattgaatacataaaatattggcataaactatcaagtttcggcgaaaaatatttgttgctcagttttctctactacaacgccactttaaaatcgcagtgctgttcagaacggagatatacggcattccttgtgaaatatgggagtaagaagagcttaaataatttaattggttattaaataacaattttatttatacagatatctgtcagattacatctggcttaaatttttgtcagcccagatgcgttttccatcaagtaacgttaccatcggcgtccggccgcaacacatttttccctgatgggttcgcccctgattcccgttgttctggggcatcattttatggacaaaaacgatcagcagacacggttggaagaggggccgccagcgaaattacagtcaggaacgctgcccgaaaacttcaagttcaccgctatttcgataatccagtggccagcccccggtcgtcagttactgatgaaggggtgaaggctgggcaataatgaggaagggatactttgccttggtcagcttccgttgctgacgatgacaaaataaaaaaacgggaggtcgataacaatctcccgtttttcgcattacgtactcgttcgtgaaatactaatgcgtttacatacgggttcaccgcgtttgcgaagcgcgccccagccaactgtcccagtctttccagacgggctgcaatccttgcgcgcttaacgcgcttgctactgtttcaggccgacgggcatcgtggggagaaaactgctccagttccggatgatcgtcagcgtagccgccgggctgcgtttttgagaaggcgctgacgttgttgattgccagaggaatcacatggtctcgaaaccacggcgattcgcgggtggagagtgataattcaatttccggcgccaataaccggaaagcgcaaatcgtttgcaccagttgcttttcatccatcacagatgcgggttccacaccgccagtacacggacgcagacgcgggaaggaaacagaatagcgactctgccagtagtgtttctgcatccacaacagatgctccgccaccatatagcaatccacccgccagttgtccgacagaccaattagcgcgccaagaccgattttgtcgatacctgcccggcctaaccgatccggcgtttccagccgccagaaaaagtcctgtttctttcccttcaggtgatgctgtgcatagattgcctcatgataagtctcctgataaaccatcacgccatcgatccccagtgttttgagctccgcatagttttcttgcgacaagggctggacttccatctgtaaagaggaaaattgacggcggatggtgggtaaatgacggcgaaaatagtccatgccgactttggcctgatgttcgccggtgactaacagcagatgctcaaagcccagtttacggatagcatcgcattccctttgaatatccacctcatccagcgttttacgcttaatgcggttgctcatcgaaaaaccgcagtaggtacagtcgttggcacagaggtttgagagataaagcggcacgtagaaactgacggtgttgccaaagcgttgtcgggtcagcctttgcgcccgctgcgctatcggttccagataatcggcggcggcgggggagagcagtgccatcaaatcatcccggctaagatgcgcggcgttcagcgcacgttccacgtcagcggcggttttaccattgatgcgcaggcgaatatcgtcccactccagttgccgccaacggtcggtgaaggttttcatgctaacgcctccagaaatccggtgagcgggctggtggcgttggcgtaggtgctacgattacccggcaccgcctgacgcgccagtactcccgcttctacagccaggcggaaagcggttgccatcattaccggatcgtccgccacggcaatcgccgtgttgaccagcaccgcatcagcgcccatttccagcgcctgcgccgcatggctgggcactccaatgcccgcatcaaccaccaccggcacggtggactgctggataataatctccagcatcgctttggtttccagcccctgattcgaaccgataggcgcgccgagcggcatcaccgccgcgcagccgacctcttccagccgcttgcacaacaccggatccgcgccgcagtagggcagcaccacaaaaccctgcttcaccagcgcctcggcggcttttagcgtttcgatcggatccggcagcagccagcgggcgtccggatggatttctaatttcagccagtgggttcccagcgcttcgcgcgccagttgggcggcgaagattgcctcttcggcggttttcgccccggaggtattgggcagcagcgtgacgcccgcttcaatcagcggcgccaggatagcgtcgttgtgctgacgtaaatccacgcgcttcatcgccagtgtcaccaactggctgccggaggcgcgaattgcctcgaccatcagttgcgatgaggcaaacttcccggtaccggtgaacagatgtgaatcaaacgttttgtcggcaatacgtaacatatcaaccccctgcaataacctgaaaaaacaggatctggtcgccttcctgcacgatttgctgctgccactgctcgcgcggcaggatctgctgattgagcgccagcgccgcgcccggtttaagctgattgagttgcgtgagcagctcactgacggtttgccctgcggcgcactgcatcggttcatcattgaactgaatctgcatgttgccctccgcagaccggacagccgctggcatgacgcagcgccaggctgcgccactggctggttttgccgtcaaacaggcgtagctctccgctgggcgtctcaataccgctgagtaatttgattgcctccagcgcctgcaaggtgcccatcacgccaacaaccggtccgacgataccggcggtacggcagttgcgttcaggctcgacatcgtccggccacaggcagcggtaacagccttgttcccacggtggtgtgaggaccattagctggccgccaaagccgacggcgctggcggaaattaacggagtgttgagcgccacacaggcggcgttaatctcctggcgcgtcgccatgttatcggtacagtcgagcactacgtcggcgtgtgctaccgcgtttttaagcacatcgccagtcagacgttgttgcaatacgatcagcttgctaccggggttgagctgcgccagccgtagttttgccgcctgcgccttcgggtgggcgatatcgtcggtggtgaacagaatttgccgctggagattgctcaagtgaacatcgtcatcgtctaccagcgttagtttgccgatgcctgctcccgccagatacagcgcggcaggcgaacccaatccgcctaagccgacaatcaatacatggctattgagcaacttttgctggccttcaatcgcgatatcgccgagcaggatctggcggctataacgcataaaatcatggtcattcatcgccgactcctgcgattgccagcagctctgcagtggcttcacgccagtctgcggcctgagtaatagcgctgaccacggcaatgctgccgacgccggtcgccagtaccgccggagcgcgttcaaggctgatgccgccaattgccacggtcgggtaatccgccagtcgttcaatatgactggccagctgcgccagcccctgcggggcggaaggcatctgcttggtttgcgtggggaagacatgacccagcgcgatataagaaggcttagcggcgagcgcgacgtctatctccatatcatcgtgggtcgatacgcccaggcgtaagcccgccgcttgaatcgctttcaggtcggtggtttcaaggtcttcctggcccagatgcacgccgtaagcgcggtgcttaattgccagacgccagtaatcgttgataaacagccgggcgttataacgacgccccagcgcgatggcggcgataacgtcggcttccacctcttcatcgcgtttatctttgatacgcaactggatcgtgcgcacgcccgactccagtaaacgctcaatccattcaacgctgtccaccaccgggtaaagcccgaggcggaacggcacggtggggaaatcaggctgatacatcaggcttcctcccgcttgagataaatttcgccgcctttggcgcggaagtcctctgacatatccgccatgccgatttcaatagtttgtgcggcggcgtagtcgcggacctcctggctgattttcatcgagcagaacttcggcccgcacatggagcagaagtgggcaaccttgccggactcctgcggcagggtttcatcgtgataagcgcgggcggtgaacgggtcgagcgcgaggttaaactgatcttcccagcggaattcaaagcgcgctttcgacatggcgttatcgcggatctgcgcgcccggatgtcctttggctaaatccgcggcgtgggcggcgattttgtaggtgattagcccctgcttcacatcttctttgttcggcaggccgaggtgttctttcggcgtcacataacacagcatcgcgcagccaaaccagccgatcatcgcggcaccgatcccggaggtgaagtggtcatagcccggcgcgatatcggtggtcaatggccctaaggtgtagaacggtgcttcatggcagctctccagctcttcggtcatgttgcgctggatcatatgcatgggtacgtggcccgggccttcaatcatcacctgcacgtcgtattcccaggcgattttggtcaattcgcccagcgtatgcagctcggagaactgcgcttcgtcgttggcatcctgaatggagccggggcgcaggccgtcgcccagcgacaaggagacgtcgtaggcggcgcaaatttcacaaatctcgcggaaatgttcgaacaggaagttctctttgtgatgggagagacaccactttgccatgatggaaccgccgcgtgagacaatcccggtcaggcgtttggcggtcattggcacgtagcgcagcagcacgcccgcgtgaatggtgaagtagtcgacgccctgttcagcctgctccagtagcgtgtcgcggaacgcttcccaggtaagatcttcggcgatcccgttgaccttctccagcgcctggtagatcgggacggtgccgatcggtaccgggctgttacgcaggatccattcgcgggtttcatgaatatagcgaccggtggagaggtccatcaccgtgtccgcgccccagcgggttgaccacaccagtttttccacctcttcttcgatggaggaggtgaccgccgagttaccgatgttggcattcactttgaccaggaagttgcggccgataatcatcggctccgattccgggtggttgatgttggcgggaataatcgcgcggcccgcggcgacttcatcacgcacgaattccggcgtaatgttttccggcaggcgcgcgccaaagttcatccccggatgctggtggcgcagcacttcactgcgaatgcgctcacggcccatattttcacggatggcgatgaactccatttcgggagtgacgatccccttgcgggcgtagtgtaactgggtgacgcgcttgcccgctttagcgcgttttggcgtcagcaggccggtaaaacgcagatcgtccaggccatcgtcggccagacgttctctggtataagccgagctacggtcgtctaattcttcgctatcgttacgtgcgtcaatccatggctggcgcagtttcgccagaccctgctggacgttaatcgccacctcaggatcgccataggggccggaggtgtcgtataccggtacggcttcgttctcttcaaactgcgggttgtctttactgccgccgatgagcgtggggctaagttgaatttcgcgcatcggtacgcgaatatcatgctgcgaaccggtcacgtagatgcgtttcgagttgggaaacgcggtgccttccagcgtatcgataaaatgctgggctttagcgcgctgctcgcggcgggttaacgttgttgtagacatagctcattccaaaaaattaaggacgtggcttgtcagacgacggatggagtaatggatgtgcgccgcccgtaaaggcagcagcataaagcagaattactcttgttcccttcgcaggtattaacctgatcaggttccgcggatcccgaattaacggtctcagccttttccacttcatccttcgcgctgcctcttcgttggcttcgtccgctcactccagtcacttacttatgtaagctcctggagattcaccgacttgccgccttgacgcatcacgaacgcttttgtggaaaattagcactccgacaagataaccgcccctccgaagagggggctgaagtaaactacccgttactcgcgcagaactcaagcgggacgtttgactctggcgccgtcgtgcatcgcgtcaaacaccagcataatcagcttgtcttccagcacaaagcgggcttccagcgcttcgccgatatctgacagagcttgttgaaattcgagacaattatcgtgatcgatggcagtttccaggctggtgtcgtaataatccataatgcgctgcgtattatcttccagcagcggccagatttttgccgcatgtaaaagctgaccgtttccttccaatttatggagaatacgttcataaatactgaagtgcccggcggaaaggtaatcgaccaggctctgacaaaaatcatccagcgctttttcattcagccgcatgtacgattctttgccaggcttaatgccaaccagattgtagtaagccacgagcaggtgcttacgtacatccagccagcgatcgaccagtttgttgcttccgccaacgcgctccgtcaggttttccagctggtttagcatgattgtctccgcaagttagataaaggctgctcgccatgaatgtaaaaataatgttaacaacatgccagtgaagcaaaggtagtgcaatagctatggatcgtataattgaaaaattagagagtggctggtggatcgtcagccatgaacaaaaattatggttgccgtatggggaattaccacacgggctggcggcaaatttcgatcttgtggggcagcgcgcactccggataggtgaatggcaaggcgagcccgtttggctggtgttacagcatcgacgtcatgatatgggatcggttcgccaggttatcgatcaggaggccgggttgttccaactggcgggacgtggcgtacagttggcggagttttatcgttcgcataaattttgcggctattgcgggcaccctatgcacccgagtaaaaccgaatgggcgatgctgtgcagccattgccgcgagcgttactacccgcaaatcgccccctgcattattgttgccattcgccgtgaggattccatcctgctggcccagcacgttcgccaccgcaacggcgtgcataccgtgctggccgggtttgttgaagtcggcgaaaccttagaacaggcggtcgcgcgagaggtaatggaggagagcgggattaaggtgaaaaatctgcgctatgtgacttcccagccgtggcctttcccgcagtcgttgatgaccgcttttatggcggagtatgacagcggcgagattgtcatcgacccgaaagaactgttggaagcaaattggtaccgttatgacgatctgccgctactaccgccaccgggcaccgtcgcgcgccgtttgatcgaagatacggtggcaatgtgtcgggctgaatatgattgacatgttacactgggcgcatcaacgctaaaggaatgtaaaaatgaccgaactcaaaaacgatcgttatctacgtgcgctgctgcgccagcccgttgatgttacgccagtgtggatgatgcgccaggcgggccgttatctaccggagtacaaagccactcgcgctcaggcgggcgattttatgtcgctgtgcaaaaatgccgaactggcctgcgaggtcactttacagccgctgcgccgttatccgcttgatgcggcgatccttttctcggatatcctgacgattccggacgcgatgggcctggggctctattttgaagctggggaaggcccgcgctttacagcccctgtcacctgcaaagccgacgttgaaaaactgccgattccggatccagaaggtgaactgggctacgtgatgaatgcggtgcgtacgattcgccgcgaactaaaaggcgaggttcctctgatcggcttctccggcagcccgtggacgctggcgacttacatggtggaaggcggcagtagcaaagccttcacggtgattaaaaagatgatgtacgctgacccgcaggcgttgcatctgctgctggataagttggcgaaaagcgtcacgctgtacctcaacgcgcagattaaagcgggtgcgcagtcggtgatgattttcgatacctggggcggcgtgctgactggccgcgattaccagcaattctccctctactacatgcataaaatcgtcgatggcctgctgcgtgaaaacgacggtcgccgggtgccggtaacgctgttcactaaaggtggcggtcagtggctggaggcgatggcggaaaccggctgcgacgcgctgggtctcgactggacgacagatatcgccgatgcgcgccgtcgcgttggccataaagtggcgctgcagggcaatatggacccctcgatgctgtatgcgccgccggcacggatcgaagacgaagtagcgactatacttgctggtttcggtcagggagaagggcacgtctttaaccttggacatggcatccatcaggatgtgccgccagaacatgctggcgcatttgtggaggcagtgcaccgactttctgcgcagtatcacaactaaggagttagcatggatctcgcgtcgctacgcgctcaacagatagaacttgcttcatcggtttgccgcgaagatcggttggacaaagatccgccagcgtttatcggcggggcggacgtcggttttgagcagggcggcgaggtgacgcgggcggcgatggtattgctgaaatatccgtcgcttgaactggtagagtacaaggtggcgcgtattgccaccaccatgccgtatatccccggctttctctcttttcgtgaatatcctgcgctgctggcggcgtgggaacagctctcgcaaaagcccgatttgctgtttgtggacggtcacggtatttcgcatccgcgtcggcttggcgtcgccagtcattttggactgttggtggacgtgccgaccatcggcgtggcgaaaaaacggctatgcggtaaatttgaaccactttccgccgaacctggcgcacttagccccttaatggataaaggcgagcaactggcgtgggtatggcgcagcaaggcgcgctgtaatccgctgtttatcgcgacagggcaccgggtcagtactgacagcgcgctggcgtgggtacagcgctgtatgaaagggtatcgcctgccggagccgacgcgctgggcggatgccgtcgcttccgggcgtccggcgtttgttcgttggcaagaaattcagcgctgattcaggtaaactgccgctaatttccgattcgagattccatcatgttacaaaacccgattcatttgcgtctggagcggctggaaagctggcagcacgttacctttatggcctgcttgtgcgagcgcatgtacccgaactacgccatgttttgcaagcagacggaattcggcgacggacagatctaccgtcgcattctggatctgatctgggaaaccctgacggtgaaagatgcgaaggtcaatttcgatagccaactggagaagtttgaagaggcgattccggcagccgacgactatgatttgtacggcgtttacccggcgattgatgcctgcgtcgcattaagcgaattaatgcattctcgtcttagcggcgaaacgctggaacacgctattgaggttagtaagacttccattactacggtagcgatgttggaaatgactcaggctggtcgggaaatgaccgatgaggagctcaaaacgaaccctgccgttgaacaggaatgggatattcagtgggaaatattccgacttttagccgactgcgaagaacgtgatattgaactgataaaagggctcagggcagacctgcgcgaggctggcgagagcaatatcggtataaattttcagcaatgacaccagaaaacgtgatttaacgtctgatttgtcgtgccataaggcttcccttatgccccccgtctggtctacatttgggaggcgaaaaaaagtggctatcggtgcgtgtatgcaggagagtgcttttctggcatttccgtcgcactcgatgcttagcaagcgataaacacattgtaaggataacttatgaacaagactcaactgattgatgtaattgcagacaaagcagaactgtccaaaacccaggctaaagctgctctggaatccactctggctgctattactgagtctctgaaagaaggcgatgctgtacaactggttggtttcggtaccttcaaagtgaaccaccgtgctgagcgcactggccgtaacccacagaccggtaaagaaatcaaaatcgccgccgctaacgtaccggcgtttgtttctggtaaagctctgaaagacgcagttaagtaagacgcataactgtgaacagttttatcgaaggggctcatcagccccttttgtctgtctggcgtcgcgcgtttctgttttctggcgcgctgttgctgactgcctgcagtcataacgcttcaccgcctccgtttactgccagcggctttgccggcgatcacggcgcggtgcgtatctggcgtaaagatacgaacgatgaagtccatctgctttctgtttttagcccgtggcatagcggcagcacgacgaccagcgaatatcgttggcagggtgatacgctttcgcttattgaactcaatatttacagcaaaccgccagaacatattcgcgcgcgtttcgacgctcatggcgaactcagttttatgcagcgtgaagtcggggggcagaagcagcagctttccaacgatcagattgccttgtatcgctatcgcgccgaacaaatccgtcagaccagcgacgccttgcgcctggggcgggtcatactacgccagggacgctggcacgccgaccatacggtaaccacctgtgaaggtgaaacgctgaaaccggatctggattcctgggcaataagccacattgagcgccgccagaaccactcatcggtagaggtgagcgtagcatggctggaggcgccggaaggatcgcaacttttgctggtggcgaattcagatttttgtcactggcagccgcaagcgaaaagcttttgatggaataccggatggcgaagccgccattcggcaaacatgctttaccagtttcccatacccatgtgaccgccgccgcgatgataaccgccgccatagccgccgcaaccgccatagcccattcctgcgccgcgtggtatgccagcctgcgccatcgcgacatcccgtttcacgcgttgctcatctaacttctggcctaatgactccatctctttggcaaccgcgttaattttcgcagtatccggcgaactggcggtcagtagcgcgttgtattcataacgtttggatatcagttgctggcgcagcgcgctggtctgcgtatagtaatcatcataaatcttctgcgccgtcgcctgctgttccgtagttaacgggctacctccctgttgccacataccgtcattgttgccccagtgatgcccggcgaaggcggcgccggagctcagggccaaaagagagagggcaattagcgcgatagctgatttattgttccgtttcattttgcgttctcctgttgctcatcttatcctctctcttgcatcttccgtgccaggtaactattccttgtcgggcagcgagttaacccgcttcaggcggcaaaaagcgagtaaaaatgactcgcataacccgcctggcgagtcatttttacccatccgtatccgaaagggtgtgcgacaacgcgcggttatgcggagcgaagaatggcatgatctctgcttaagtaaggaaaataaaaacgagccggggaagcctgtgagttttatacgattacataaagatgccgctgcaacgtggttgagtcgactgttacctgcggcgatcttcattctggtggggctattttccattatggtcattcgcgactatggccgtgagagcgctgccgccaggcagacgctgctggaaaagggaaatgtactcattcgcgctctggagtccggcacgcgagtaggtatgggaatgcggatgcatcacgcgcagcagcagacattgctggaagagatggcgggtcagccaggcgtgttgtggttcgccgtaacggatgcgcagggggtaatcatcactcatagcaaccctggcatggtgggcaaatcgctctattccccatctgaaatgcatcaactaaaccccgggccgcaggagcgttggcggcgtgtcgacgttgctgctaacggcgagacggtgcctgcgctggaaatttaccgtcagttccagccgcttttcggtatgagaggtcacggtatgagggggcacggcatggcgcgtagcgccaatgacgacgaaccagcgaaacaaactatttttattgcctttgacgccagcgagctggccgcgacacaggcaagggagtggcgtaatacgctgattgttttgtctgcgttagcggcggtgctgttggcaacgttactggcgtttttttggcatcagcgttatcagcgctcgcacagagaactgcttgatgcaatgaagcgtaaagaaaagctggtggcgatggggcatctggcggcgggcgtcgcgcacgaaattcgtaacccgctctcgtccatcaaagggctggcgaaatactttgccgagcgcacgcctgccggcggcgagtcgcatgaactggcgcaggtgatggccaaagaggccgaccgtttgaaccgggtggtaagcgaattgctcgaactggtaaagcccgcgcatctgacgctccagacggttaacctcaatgatattattactcactccctgaatctggtcagtcaggatgcccaaagcagagagattcagttgagattcacggcgaatgagacgcttaagcgtattcaggctgacccggacaggctgactcaggtgctgttgaatctgtacctgaacgctattcatgcgattggccgccagggaacgattagcgtagaggcaaaagaaagtgggaccgaccgcgttatcatcactgttaccgatagcgggaaagggatcgccccggatcagctggaggcgatttttacgccttattttacgaccaaagctgacgggacaggcctggggctggctgtggtgcaaaatatcatcgaacagcatggcggcgcgattaaggtgaaaagtattgagggtaaaggcgcggtctttactatctggttgccagtgatagcgagacaacaggattaacaagggtgatacgcggaaaaatcgatattctggttgtggatgatgatgtaagccactgcacgattttacaggcgctgcttcggggctggggctataacgtcgctctggcctacagtgggcatgatgcgttggctcaggtgcgtgagaaagtctttgatctggtactgtgcgatgtgcgtatggcggagatggacggtatcgccacgctgaaggagattaaagcgctcaatcccgccattccgattttgattatgacggcattttccagcgtggaaacggcggtagaggcgttgaaagccggcgcgctcgactatttaattaaaccgctggattttgaccgtctgcaggagacgctggaaaaggcgttggcgcatacgcgggaaacgggcgctgaattgccatcggcgtcggctgcgcagtttggcatgattggcagcagtccggcgatgcaacatttactgaatgaaatcgcgatggtcgcaccatcagacgccacggtattgattcacggagactccggcacgggtaaagagctggtggcgcgggcgctacacgcctgtagcgccaggagcgatagaccgctggtcacgctcaactgcgccgcgcttaatgaatcgctgctggagtccgagctgttcggacacgaaaaaggcgcgtttaccggcgcggataaacgtcgggagggacgctttgtcgaagctgacggcgggacattgtttcttgatgaaatcggcgatatctcgccgttaatgcaggtacgtttgctgcgggcgattcaggagcgcgaagtgcaacgcgtgggaagtaaccagacgatatctgtggatgttcggttaattgccgctacccaccgcgacctggcggaagaggtgagtgccggtcgctttcgccaggatctctattaccgcctgaatgtggtggcgattgaaatgccttctttgcgccagcgtcgggaagatattccgctactagcagaccattttctgcggcgttttgccgaacgtaaccgcaaagtggtgaaggggtttacgccgcaggcgatggatctgctgatccactacgactggccgggcaatatccgtgagctggaaaacgctatcgagcgggcggtggtgttgctgacgggagaatacatttctgaacgcgaattgcctctcgctattgccgcgacgccgataaaaacggaatacagtggtgagatccaaccgctggtggacgttgaaaaagaggtgattctggcggcactggaaaaaacgggcggcaacaaaacggaagccgcccgtcaattgggcattacgcgcaaaacgctgctggctaaactcagccgttagttttgctcacgctcaatggcgcgccagccaatgtcgttacggctgaagctgccgtcccagcggatgtcggtcatcagggcgtaagcgcgtttctgcgcctcagccacggtgtggcccagcgcggtggcgcacagtacgcggccgccgctggtcaacacgcggtcgtcatcggcgagtttggtgcccgcgtggaaaactttaccgtcagccacttcttccagcggcaggccgtggatctcgtcgccggtgctgtagctgcccggataaccgcccgcggcgatcaccacgcctaatgaagcgcgttcgtcccactcggaggttttctcatccagcttgccgtcgcaggcggccaggcaaagatccaccaggtccgacttcatgcgtagcatgatcggctgggtttccggatcgccgaagcggcagttgaactcgataactttcgggttgccctgcttgtcgatcatcagacccgcgtacaggaagccggtataggtattcccttctgccgccatgcctttcacggttggccagatgatccgttccatggtgcgctggtggacttcatcggtcaccactggagccggagagtaagcccccatgccgccggtgttcgggccggtatcgccgttgcctacgcgtttgtgatcctggctggtggccatcggcagcacgtgctcgccgtcgaccatcacgataaagcttgcctcttcgccgtcgaggaactcctcaatcacgatacggtggcccgcgtcgccaaaggcgttgcctgccagcatgtcatgaacggcggcttcggcttcttccagcgtcatcgccacgataacgcctttaccggcagccagaccgtcagctttgatgacgatcggcgcgcctttctcacgcagataagccagggctggctcaatctcggtgaaattctggtattccgccgtcggaatctggtgacgagcgaggaaatctttggtgaaggctttggagccttccagttgggcggccccttcggttgggccaaagatcttcagacccgccgcgcggaacgcatcgaccacgccaatcaccagcggcgcttccgggccaacgatggtcaggtcaatcttctcgtgctgggcaaagctcagcagcgccggaatatcggtgacgccgatagccacgttctgcaacgcgggctccagcgcggtaccggcgttacccggtgcgacaaaaacagtatcaaccagcggcgactgtgcggctttccaggccagcgcgtgttcgcgtccgccgttaccaatcactaatactttcatgtttcgctccattaatggcggaagtggcgcatgtcagtgaagatcatcgcaataccgtgttcgtcggcagcggcaatcacttcgtcatcacggatagaaccgccaggctggatcacacagctcacgccaacggcggcagcggcatcaataccgtcacggaacgggaagaacgcgtcggaggccatcgcggaacctttcacttccagaccttcgtcagccgctttaatgccagcgattttcgcggagtacacgcggctcatctggcctgcgcctataccgatagtcatgttctctttcgcatacacaatggcgttggatttcacgaacttggcgaccttccagcagaacagcgcatcgcgcagctcctgctcggtcggctggcgtttagagaccacgcgcagttcagcttcgctcaccatacccagatccctgtcctgaaccagcaggccgccgttaacacgcttgaagtccagacccggcacacgctgtgcccactgaccgcaggtcagaacgcgaacgttctgtttggcggcggtgattttcagcgcctcttcggttgcggacggggcgatgatcacttccacgaactggcgggagataatggcctgcgcggtttcggcatccagttcgcggttgaaggcgataatgccgccgaacgcggaggttgggtcggttttatacgcacggtcgtaagcgtcgagaatagtggtgctcaccgccacgccgcacgggttagcgtgcttgacgattacgcaggctggctcgttgaactctttcacacactccagcgccgcgtcggtatcagcgatgttgttgtaagaaagcgctttgccctgaacctgctgtgcggtggcaacggacgcttctttcacattttcttctatatagaaggctgcctgctggtggctgttctcgccatagcgcatatcctgcttcttaatgaagttcagattcagcgtacgcgggaagcgaccggcggcttctttgctttcaccgtggtaggccggaaccatgctgccgaagtagttagcgatcatgctgtcgtaggcggcggtgtgttcgaaggctttaatcgcgagatcgaaacgggtgtcgagggtcagagaaccttcgttagcatccatctctttaataatggcgtcgtagtcgctgctcttcaccacgatggccacgtctttatggttcttagcagcagagcgcaccatggtcgggccgccgatatcaatgttctctaccgcatcttccagcgagcagccttcgcgtgccacggtctcggcgaacggatacaggttaacgacaaccatatcgataggggcgatgtggtgctgttccataatggcatcgtcctggccgcgacgaccgaggatgccgccgtggacttttggatgcagggtctttacgcgtccatccatcatttccgggaaaccggtgtaatcggaaacttcggtcaccggcaggcctttttctgctaacaggcgggcggtgccccccgtagacagcagctccacaccgcgtgcggaaagtgcctgggcgaattcgatgataccggccttgtcagaaacactgagcagagcgcggcggactggacgacgttgttgcatggtaaatcccctggatttgacgattacagagagcgttagctgaatttttcgtgaaaaactcagctaacgccccttatggggtattctcattttgcggcgacattgtaacgaaaacgtttgcgcaacgctcgcgaatttttctttttaaattctggccccgcttttatccctgaaagatcatttgcagagtgagaagatccaggagatgaacgcgcattttgtggataagtctgtgcgtaaatgggtataaccaggggttttgctggggaatgcagcaaacagtcatttttctgcaatttttctattgcggtcagcagagaactccctataatgcgcctccatcgacacggcggatgtgaatcacttcacacaaacagccggtcggttgaagagaaaaatcctgaaattcagggttgactctgaaagaggaaagcgtaatatacgccacctcgcaacggtgagcgaaagccgcgttgcactgctctttaacaatttatcagacaatctgtgtgggcactcgaagatacggattcttgacgtcgcaagacgaaaaatgaataccaagtctcaagagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagctagttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaaacctgcggttggatcacctccttaccttaaagaagcgtactttgaagtgctcacacagattgtctgatgaaaagtgaatagcaaggcgtcttgcgattgagacttcagtgtccccttcgtctagaggcccaggacaccgccctttcacggcggtaacaggggttcgaatcccctaggggacgccagcgttcaaactgatgaggtcaaacctccaggggacgccacttgctggtttgtgagtgaaagtcacctgccttaatatctcaaaactgacttacgagtcacgtttgagatatttgctctttaaaaatctggatcaagctgaaaattgaaacacagaacaacgaaagttgttcgtgagtctctcaaattttcgcaacacgatgatgaatcgtaagaaacatcttcgggttgtgaggttaagcgactaagcgtacacggtggatgccctggcagtcagaggcgatgaagggcgtgctaatctgcgataagcgccggtaaggtgatatgaaccgttataaccggcgatacccgaatggggaaacccagtgtgattcgtcacactatcattaactgaatccataggttaatgaggcgaaccgggggaactgaaacatctaagtaccccgaggaaaagaaatcaaccgagattcccccagtagcggcgagcgaacggggaggagcccagagcctgaatcagcatgtgtgttagtggaagcgtctggaaaggtgcgcgatacagggtgacagccccgtacacaaaagcgcatgtgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacaggtttacctgtgtgactgcgtaccttttgtataatgggtcagcgacttatattctgtagcaaggttaaccgtataggggagccgtagggaaaccgagtcttaaccgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaattcatctccgggggtagagcactgtttcggctagggggccatcccggcttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgaacgtatcacccaagacaactttacggagttgacgattgacggagcgaagcgacgtcaaagcgttcattaaagtcgagttggcttagggatacgttcgttgggtaggggagcgttctgtaagcctgtgaaggtgtgtcgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacgggttaatattcccgtacttggtgttactgcgaaggggggacggagaaggctatgttggccgggcgacggttgtcccggtttaagcgtgtaggtgtgtgttccaggtaaatccggttcactttaacactgaggcgtgacgacgaggcactacggtgctgaagcaacaaatgccctgcttccaggaaaagcctctaagcatcaggtaacacgaaatcgtaccccaaaccgacacaggtggtcaggtagagaataccaaggcgcttgagagaactcgggtgaaggaactaggcaaaatggtgccgtaacttcgggagaaggcacgctgacacgtaggtgaagtgatttactcatggagctgaagtcagtcgaagataccagctggctgcaactgtttattaaaaacacagcactgtgcaaacacgaaagtggacgtatacggtgtgacgcctgcccggtgccggaaggttaattgatggggtcagcgcaagcgaagctcctgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgtggacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagatgttttggcggttaagagaagattttcagcactgattccggattttcgggaacgaaagattttacgctgaggcaaggcggcaaatgaaggaaaggaaggagcatacagaagtatgtgactgactttgcgaatgcagccaacgcagcatcggtgtaaaagattcgtttctggcaacagaatttgcctggcggccgtagcgcggtggtcccacctgaccccatgccgaactcagaagtgaaacgccgtagcgccgatggtagtgtggggtctccccatgcgagagtagggaactgccaggcatcaaattaagcaaaaggctcagtcgaaagactgggccttttgttttatctgtggtctgtcggtgagcactctcctgaggaggagaaatccgccgggagcggatttgaacgttgcgcagcaacggcccggagggtggcgggcaggacgcccgccataaactgccaggcatcaaacaagtgaagaagcccgtccgtcaggacgggcttttttgcgtgtgcggtaactgtaaaaatgtaggcctgataagcgcagcgccatcaggcaacctgcaccgccggatggccgcttcgccttatccggcctacatgcacttatcagacagcgccgctactcacggataaattaaattcaataatggatacggtttcccaagatcgtcgacctccgaacgtcccgtcaccttgaatcccattttcttataaaatccaacagcttgtgtattttgctcgttaacattggttgtcaatcccggcgccagtgttaacgcatgttcaaccagcatcttaccgataccctgaccgcgcacgtccggatctataaacagagcatccatatgctcaccggtaagcagcataaaccctaccggctcatcctgatcggtcacggcaacccatagtggcgcttctggcagaaaatcgctcaccagttcttccagttcggcccgataagcgtttgacagaaaatcgtgcgtggcatcgactgagcgacgccagatcgcaatcagtttttccccttcctcatgccttgaacggcgaatgttaatcatcatcttcactccttttttgcttacttctattctaatgcaaatgctgtcgtgaaactttctcaccttgaacttgcagactcgacattcgcctgatttctgagtatcttcagctatctggatgtctaaacgtttaaacgtatgtcgtgaggttatcaggttatgccgattcgcgtgctggacgagctacccgccgtcaattttttacgtgaggagaatgtcttcgtcatgacgacttctcgcgcatcaggtcaggaaattcgcccgctaaaggtacttatccttaacctgatgccgaagaagattgaaacggaaaatcagtttctgcgtttgctatcgaactcgccattgcaggtcgatattcaactactgcggatagatgcccgcgagtcgaggaacacgccagccgagcatctgaacaacttttactgtaacttcgacgatatctgcgatcagaactttgatgggcttatcgtgaccggagcgccgctgggtctggtggagtttaatgacgtggcttactggccgcagattaggcaggtgctggaatgggcgaaagatcacgttacttcgacgctatttgtctgttgggccgttcaggccgcactcaatattctgtatggtatccctaagcagacccgtacagataaactttccggcgtctatgaacatcacatccttcatccacatgctctgttaacgcgtggttttgatgattcgtttctggcgccacactcacgctatgccgatttcccggcggcgctgatacgggattatacggatcttgaaattctggccgaaacagaagaaggggatgcgtacctgtttgccagcaaagataaacgtattgcgtttgtcaccggtcatcctgaatatgacgctcatacgttagcgggtgaatattttcgtgacgttgaggccgggttaaatccggaggttccgtacaactatttcccaaaaaacgatccgcaaaacataccgcgcgcaacctggcgcagccacggtaatttactgtttactaactggctcaactattatgtctaccagattacgccatatgatctgcgtcacatgaatccaaccctggattaatcttctgcttctgacgatcctaaagcgtttcagcatgttgaatcaggcaccttcgggtgccttttttatttccgaaacgcacctcatcatgtaattaaatttaatttatattgttatcaataggttaatgcataattaaattaaaaatggaaattgtttttgattttgaaatttaattgagtagtcttagttgtgttgaacgaaaagtgcacagtgatccttcgttcgcattggggatgtatctggatcaacaacgaggagctgcatgatgaatccacaggcaaccacaactgatgaattaacctttaccaggccgcaaggcgagctggaaaagcaagtcctgaccgctgaagcagtcgagtttttgacggagttagtcacccgttttacgccaaaacgcaataaactcctggctgcccgtatccagcaacagcaggatattgataacggtaagttgcctgattttatttcggaaaccacttccattagagaaagtaattggcagattcgtggtattccggcggatttacaggatcgccgagtagaaattaccgggccggttgaacgtaaaatggtgattaatgccctgaacgcaaatgtgaaagtgtttatggcggattttgaagactcgctggcgccggactggaataaagttattgatggtcaaatcaacctgcgtgatgcggtgaacggcaccattagctataccaacgaagccggaaaaatctatcagctcaagcccgatccggccgtattgatttgtcgtgtacgtggtctacatctgccagaaaaacatgttacctggcggggggaagccattcccggcagcctgtttgattttgctctgtactttttccacaactataaagcgctgctcgctaaaggtagcggcccgtatttttacctgccgaaaacgcaagcctggcaggaggcagcctggtggagcgaagtgttcagctacgccgaagaccgctttaacctgccgcgcggtacgatcaaagcgaccctgttgattgaaacgctgccggctgttttccagatggatgagattcttcatgcgctgcgtgatcatatcgtcggtctcaactgtggtcgctgggattatattttcagctatatcaaaacgttgaaaaatcacccggatcgcgttttgccggacaggcaggtggtaacgatggacaaaccgtttctgagcgcctactcgcgcctgctgatcaaaacctgccacaagcgcggcgcgttcgcgatgggcggtatggcggcgtttatcccgagcaaagacgttgaacgcaacaatcaggtccttgccaaagtgaaagcggataaagcgctggaagcgaacaacggccacgacggcacgtggattgcgcatcctgggttggcggataccgcaatggccgtctttaacgaggtactgggcgagcacaaaaatcagctgttcattacccgtgatgaagatgcgccgattaccgctgaacagttactggagccatgtgaaggcgaacgcacagaagcgggaatgcgcgccaatattcgcgtggcagtgcagtacattgaagcgtggatctccggcaatggctgtgtaccgatttacggtctgatggaggatgccgcgacggcggaaatctcacgaacctctatctggcagtggattcaccatgagaaaacactgagcaatggaaaacccgtaacgaaaacgcttttccgcgaaatgttggcggaagagatgcgggtaatccaggacgaactgggcgagcaccgctacagcagcgggcgcttcgacgatgccgcacgtctgatggagcaaatcaccacctcagatgacttaatcgacttcctcaccctgccgggctatcgcttactggcttaattcaccacataacaatatggagcatctgcacatgaaaacccgtactcaacaaatcgaagaattacagaaagagtggacacaaccgcgctgggaaggcatcacccgcccgtacagcgcggaggaggtggtgaaattacgcggctcggttaacccggaatgcacgctggcgcagctcggcgccgcgaaaatgtggcggctgttgcacggtgaagcgaaaaaaggctatatcaacagccttggcgcgctgaccggcggtcaggcgttgcagcaggcgaaagccggtattgaggcgatttatctttcaggctggcaggtggcggcagatgccaacctggcatccagcatgtatccggatcaatcgttgtacccggcaaactctgttccggcggtagtggatcggatcaacaacacttttcgtcgtgcagatcagatccagtgggcatccggtattgaacccaacgatccgcgctatgtggattacttcctgccgatcgttgctgatgcggaagccggttttggcggcgttctgaatgccttcgaactgatgaaatcgatgattgaagccggtgcagcggccgttcacttcgaagatcagctggcgtcggtgaagaaatgcggccatatgggcggcaaggtgctggtccccacgcaggaggcgattcagaaactggttgctgcgcgtctggccgctgatgtgatgggcgtcccgacgctggtgattgcgcgtaccgatgcggatgcggcagatctgatcacctccgactgcgatccctatgacagcggttttattaccggcgaacgcaccagcgaaggtttctaccgcacccatgcgggcattgagcaggcgatcagccgcggtctggcgtatgccccgtatgccgatctggtatggtgcgaaacctctacgccggatctcgaactggcgcgtcgttttgccgatgctatccacgcgaagtatccgggcaaactgctggcctataactgttcaccatccttcaactggcagaagaatctggacgacaagaccattgccagcttccagcagcagttgtcggacatgggttacaaataccagtttattaccctggcgggcatccacagcatgtggttcaacatgttcgacctggcgcatgcatacgcgcagggcgagggcatgaagcactatgttgagaaggttcaacaacccgagttcgccgcggcgaaagatggctacacctttgtttcccaccagcaggaagtgggtactggttacttcgacaaagtcaccaccattattcagggcggcgcgtcatccgttaccgcgttaacgggttccaccgaagaagcgcagttttgattgatgcccggtggcgctgcgcttaccgggcctacagatagcgtaggccggataagcgaacgcgccatccggcatgacgtggtgccggatgagggaaaaaaatgccgcgtggcctggaattactgattgctcaaaccatcctgcaaggctttgacgcgcagtatggtcgatttctggaagtgacttccggcgcgcagcagcgttttgaacaggccgactggcacgccgtccaacaggcgatgaaaagccgtatccacctctatgatcatcatgtgggtctggtggtggagcaactgcgctgtattaccgatggcaaaagtaccgacgcggatttccttttacgcgttaaagagcattacacccggctgttgccggattacccgcgcttcgagattgcggagagctttttcaactccgtttattgccggttatttgaccaccgctcgttaacacccgagcggttgtttattttcagttcgcaaccggagcgccgcttccgtactatcccgcgcccgctggccaaagacttctttcccgatcacggttgggagccgctgttgatgcgcatactcagtgacttaccgctgcgtctgccctggcagaataaaagccgggatatccgctatattatcgcgcacctgactgaaacactgggcgaggacgcgctacctcgctgccatgtccaggtggcgaacgagttgttttaccgtaataaagcggcctggctggtaggtaaattaaccacacctgacggtacgctgccgtttttattgccgattcatcgcactgatgagggggaactgtttgtcgatacctgcctgaccaccacggcagaagcgagcattgtgtttggttttgcccgctcttattttatggtgtatgcgccgctgcctgccgcgctggttgagtggttgcgtgaaatcctgccgggtaaaaccactgccgaactgtatatggcgattggctgccagaaacatgcgaaaaccgaaagctaccgcgaatatttatgttatctggctgaaagcgatgagaaatttattgaggcgcctggcatccgcggcatggtgatgctggtgtttaccctgccaggtttcgaccgggtatttaaaatcattaaagacaaattcgccccgcagaaagagatgtctgccgcccatgtgcgtgcctgttatcaactggtaaaagagcatgatcgcgtcggtcgtatggcggatacccaggagtttgagaatttcgtgctggataaacggcaaattgatccggcgctgatggcgctgttacgacaagaagcgccagagaagattaccgatcttggggaacatatcgtcattcgccatctctatattgaacgtcgcatggtgccgctcaatatctggctggaacaggtagaaggccagcagttgcgcgatgcgatagaagaatatggtaatgcgattcgccagcttgccgccgctaatattttccccggcgatatgttgtttaaaaactttggcgttacccgtcatggtcgcgtggtgttctacgactacgatgaaatttgctacatgacggaagtgaatttccgcgatattccgccagcgcgttatccggaagacgaactggccagcgaaccctggtatagcgtctcgccaggtgatgttttcccggaggagtttcgccactggctgtgtgccgatccgcgtatcgggccattgtttgaagagatgcatgccgacctgtttcgcgccgattactggcgcgcgctacagacgcgtattaaagaagggcatgtagaagatgtgtatgcctatcgacgtagacagcgctttagcgtgcgttacggcgcgatctcaagtacggcgaactcttcgtaaaccagttccatctccggcgaccaattaccctcgcgctcaaaaaaggcccggtgtgccgcttgccagtacgccaggctaagatcgccttcgccttccagtgcggcgagatcggcgctcatctcgttaaaacggatcagcctgagcgccagcgtgcgtatgacgcacacggcgtcgcctgtgccgttgagcacaatgtgatatgacccgggcgtgacagggggttgctctttctgatagctaaccagcgagctacaggtgccacgctttttaccggcgaccactagcgccgccagctcgtcggccagcgccggcgaatcaccgaaagaccaacagaaggcctgtgggtacttctcctgccagtataatttcaggctgctcatttcagcgagttccaccataggccagcgttacctctttcgccgctttaatcaccatggcgccaagttcggtgacgcgatcgtcggtaatgcgtgagcaggggccggaaatagagagggccgcaaacggttcgcggtgttcgtcataaatacacgaggccacgcagcgcagaccgagcgcatgttcttcgtcgtcaaaggaatagccgcgcttgcgtgtttgggcgaggtcatctttcagatgcagcggcgacaccagcgtcgcatgggtataagcgtgcaaccccttgcggtgcagcagactggtaacctgttcctcactgagctgtgataaaaacgccttgcccgcgccagaggcgtgcatgggcagcttgccgccaataggggcggacatgcgcatcaattgtgtgcactgcacctggtcgataataatagcctgatggtcgctctggtcgagtacggcaaggtttaccgtttcgccggagtcctccatcagcttgcgcaaaatcggatggacaatcgccagcagattacggctctgtaagaagctgctaccgacgataaacgcgtgtgcgcctacggcccaatggcccagctcaccaacctggcggacaaaaccctgctgctgcatggtggtgagtagacggtgagtcgtggaattaggcaaacccgcctgttgcgccagttcggtcagcgcgacgctgccgttggactcggcaatccactccagcagcttcagaccgcgagttaatgactgaacctgcccggttacgggtgcagtggtagcggcaggttttctcccgcgtttcgcgggaacaggggcaaccatggcagactcctttttctgtatcgtggaaatcattttcgttttattcaattataatgcaagagttcctgaactgatcggatgagtgacatcacaggatgcccgatagcgctgcgcttatcaggcctacgctttgggagccgccaaagtaatttgtagactgataaggcgcttgcgccgccatccggcaaagcgacagaagtgggtggcaagctgaacatgtctcatgttgcccgttgttctcttttccgccagcacgctttgtgccagtatggctcgttacgtggagcgttgtcgggagcgagtgtgagcagcaaagttgaacaactgcgtgcgcagttaaatgaacgtattctggtgctggacggcggtatgggcactatgatccagagctatcgtctacatgaagaagatttccgcggggagcgctttgccgactggccctgcgacctgaaaggcaacaatgacctgctggtcctcagcaagccggaggtgatcgccgctatccacaacgcctactttgaggctggcgcggatatcatcgaaaccaacacctttaactcgacaaccattgcgatggcggattaccggatggaatccctgtcggcggaaattaactatgcggcggccaaactggcgcgcgcctgcgccgatgaatggacggcgcgaacaccagaaaaaccacgctttgttgcgggcgtgcttggtccaactaaccgcacggcctccatttcgccggacgtcaacgacccggcgtttcgtaatatcaccttcgatcagctggtggcggcctaccgtgaatccaccaaagcgctggtggaaggtggcgcagatctgattctgattgagaccgtttttgacaccctgaatgcgaaagcggcggtgtttgcggtgaaagaagagtttgaagcgctgggcgttgacctgccgatcatgatttccggcaccatcaccgacgcctctggccgtacgctttccggccagactaccgaagccttttataactcgctgcgccacgccgaggcgctcacttttggccttaactgcgcactggggccagatgaactgcgccagtacgtccaggaactgtcgcggattgccgaatgctacgtcaccgcgcacccgaacgccggcctgccgaacgctttcggcgagtatgacctcgacgccgacaccatggcgaaacagattcgcgaatgggcggaagcgggcttcctgaatatcgttggcggctgctgcggcaccacgccggagcatattgcggcgatgagccgcgccgttgccggtttgctgccgcgccagctgccggatatcccggtcgcctgccgcctttccggcctggagccgctgaacattggcgacgatagcctgtttgtgaacgtcggcgaacgtactaacgtcaccggctcggccaaatttaaacggctgatcaaagaagagaaatacagcgaagcgctggatgtcgcccgtcagcaggtagaaagcggcgcgcagattattgatatcaatatggatgaggggatgctcgacgccgaagcggcgatggtgcgtttcctcagcctgattgccggtgagccggacattgcccgtgtaccaatcatgatcgactcctccaaatgggaggttatcgaaaaagggctgaagtgcattcagggtaaaggcatcgtcaactctatttcgatgaaagagggcgtggaagcctttattcatcatgcgaagcttctgcgtcgctacggcgcggcagtggtggtgatggcctttgatgagcaggggcaggccgatacccgcgcgcgtaaaatcgaaatttgccgccgagcctacaaaattctcaccgaagaggtgggtttcccgccggaagacatcatcttcgacccgaatatcttcgccgtggcgaccggtattgaagagcacaacaactacgcgcaggactttatcggcgcttgcgaagacatcaaacgcgagctgccgcacgcgctgatctccggcggcgtgtctaacgtgtccttctcgttccgcggcaacgacccggtacgtgaggctatccacgcggtattcctctactacgccatccgcaacggtatggacatgggcatcgtcaacgccggacagctggctatctacgacgacctgcccgccgagctgcgcgatgcggttgaagatgtcattcttaaccgtcgcgatgacggcactgagcgtttgctggatttggcggagaaataccgcggcagcaaaaccgacgaagctgccaacgcccagcaggcggaatggcgtagctgggacgtgaaaaagcgtctcgaatactcgctggtgaaaggcattaccgaatttatcgaacaggataccgaagaagcccgtcagcaggccgcccgcccgattgaggtgattgaagggccgttgatggacggcatgaacgtggtcggcgacctgttcggcgaagggaaaatgttcctgccgcaggtggtgaaatccgctcgcgtgatgaaacaagcggtggcctacctggagccgtttattgaagccagcaaagaaaaaggctccagcaacggcaagatggtgatcgccaccgtgaagggcgatgtgcacgatattggtaaaaatatcgttggcgtggtgctgcaatgtaacaactacgaaatcgtcgatcttggcgtgatggtgccagcggagaaaatcctcagaacggcgcgtgaagtgaatgccgatctgatcggtctttccgggctgattaccccgtcgctggacgaaatggtcaacgtggcgaaagagatggagcgtcagggctttactatcccgctactgatcggcggcgcaaccacttcgaaagcgcatacggcggtgaaaatcgagcagaactacagcggtccgacggtctacgtgcagaatgcttcgcgtaccgtgggcgtggtggcggcgctactctccgacacccagcgtgatgactttgtcgcccgtacccgcaaagagtacgaaaccgtgcgtattcagcacgcccgcaaaaaaccgcgcacgccgccggtcacgctggaggcggcgcgcgataacgatctggcattcgattgggaacgctacaccccgccggtagcccaccgtctgggcgtgcaggaggtggaagccagcatcgaaactctgcgcaactatatcgactggacgccgttctttatgacctggtcgctggccggcaaatacccgcgcattctggaagatgaggtggtgggcgttgaggcgcagcgtctgtttaaagacgccaatgatatgctggataaactgagcgccgagaaactgttgaatccgcgtggcgtggtgggcctgttcccggcgaaccgtgtgggtgacgacatcgaaatctatcgcgacgaaacccgtactcatgttctgacggtcagccaccacctgcgccagcagaccgagaaagtcggttttgccaactactgtctggcggattttgtcgcgccgaaactgagcggcaaagcggattacatcggtgctttcgcggtgaccggcggtctggaggaggatgcgctggcggacgccttcgaagcgcaacacgacgactataacaagatcatggtgaaagcgattgccgaccgtctggcggaagcgttcgcggaatatctgcatgagcgtgtacgtaaggtttactggggatatgcgccgaacgagagcctgagtaacgacgaattaatccgcgaaaactaccaggggattcgcccggcgccgggttatcctgcctgcccggaacataccgaaaaaggcactatctggcagctactggatgtcgaaaaacacaccgggatgaagctcaccgaatctttcgccatgtggccaggcgcgtcggtctccggctggtacttcagccatcctgagagcaaatacttcgcggtagcgcagatccaacgcgatcaggtgacagattatgctttccgtaaaggaatgagcgttgaggatgttgagcggtggctcgcgccgaacctgggttacgatgcggactgattcataaaatcgtcacttttccttacaacatacaaggcactcattgggtgccttgtctctttcttacaattaaacccttatactgaaggaaggctctacgctgaatttgccggatggcggcgtaaacgccttatccagcataccgtattacgtatggtaagcccggtggcgtgcaacgccagcaggccttaacgctttgcgccatcaggcaatttatcgcaagtgagcttcaggaaaacgtataacgataaggagaacctgacgccgtgttaactttgctccatctactttctgccgttgcgctgttggtatggggaacacatatcgttcgtactggcgtaatgcgcgtgtttggcgcgcgtctacgcactgtcctcagccgcagcgtggaaaagaaaccgctcgccttttgtgcgggtatcggtgttaccgcgctggtacaaagcagtaacgccaccactttattggtaacgtcgtttgtcgcccaggatcttgtcgccctgacgccagctctggtgattgtgctgggcgctgatgtgggtactgcgctaatggcgcgtattctcacctttgatttgtcgtggctgtcgccgctgctgatttttattggcgtgattttctttttgggacgtaagcagtcccgtgccgggcagcttggtcgcgtcggtatcgggcttggcctgattctactggcgctggagctgattgtgcaggcggtgacgccgatcactcaggctaatggcgtgcaggtcattttcgcgtcgctgacgggcgacattatgctggatgcgctgattggcgcgatgttcgctattatcagttattccagcctggcggcggtgttgctgacggcgaccctgacggcggcggggattatatcgttcccggtggcgttgtgcctggtcatcggcgccaatctgggatcggggctgctggcgatgctcaataacagcgccgccaatgctgccgcgcgtcgcgtagcgctcggcagcctattgttcaaattgatcggcagcctggtcatcctgccgtttgtccatccgctggcgaatctgatggatgagctatcgctaccgaaatcagagctggtgatctatttccacgttttctataacctggtgcgctgcctggcgatggtgccatttgccgagctgatggcgcgtttttgtaaacgaattattcgtgatgagcctgaactggatacccatctgaagccgaaacatctggatgtcagcgcgctggatacgccaacgctggcgctggccaatgctgcccgcgaggtgttgcgcattggcgatgcgatggaacagatgatggaagggctaaaaaaggtcatgcacggcgagccgcgtgaagagaaagcgctgcgcaagctggcggatgacgttaacgtgctctacaccgcgattaagctttatctggcgcgaatgccaaaagacgagctggcggcggaggagtcccgccggtgggcggagattattgagatggccctgaacctcgaacaggcgtcggatattatcgagcgaatgggcagtgagattgccgacaagtcgctggcggcgcgtcgggcattttcagaagaaggattgaaagagctggatgcgctttacgatcaactgctcagtaatctgcaactggcgatgtcggtctttttctccggcgatgtcaccagcgcccgtcggttgcgccgcagtaaacatcgcttccgtatacttaatcgccgatactcacatgcgcatgtcgaccgcctgcaccagcagaacgtgcaaagcattgaaaccagctcgctccatttagggctgctgggcgatatgaagcgtcttaactcactgttctgttcggtcgcctatagcgtactggaacagccggatcaggacgaggaacggggcgagtattaagtgaaatgccggatggcggggcctacggagaacatgcgcgtaggcccgtcattcggcattcaatatggcctgggattaaaagcgatgacccgcttccagcgccacggcctcttcgcccgctttaaacacccaggtggtattcgggccgccgagaaccgcctggccgttgctcacctgaatccagttaccttccggcaaaccaatcactgtcagttccggcgcgaccaccagcagttcgcgaatacgctgctcgcgggtctcgcccttatgaccttccggcaaggcgttagtgaagtgaggattaatttgcagcgggaacagatccagcgcgtcgaaaccgtttggatcgacgatcggcatatcgttggtcgtgcggatagtcgggcaggcaaggttggcgcccgcgctccagccgatatacagcgcgccgcgttttaccctgtccgccatcggcgccagcagcccgcgttcacgcgattctttcagtagctggaaggtatttccgccgccgacaataatgatttccgctttctcaatcgccgcaagcggatcggcgacacgatgaatccctgtgacgtttacccctaatggcgcaagcacctctgcggttttatccgtgtactcgtcccatgtttgcgtgacgccggcaaacggaataaacacggctgagcgtcgaccgttcaattgattcgctatcagcggcagagcgtgttccagccaggccttacccggcagcgtcgagttacttaataaaagcagttccattacttctccacctcatcaggaaatgtcaaaacgtaataatgctaccattatccatttaatgtcttactgatatggctcatgatgttacgcgtgtcacaggcaaagcgcggtcgctaaaagtgacgacaggccagatctgccatctggtatcgcctgaaaaattacaggtataatccgcaaaattatttaacacgtttagagacgaaaatggcaaaactgaccttacaagagcaactgctacaagcgggattagtgaccagcaaaaaaatggccaaagtccagcgcacggctaaaaaatcacgcgttcaggctcgtgaggccagagaggcggtggaagaaaataaaaaggcgcaacttgagcgtgataaacaactcagtgaacagcaaaaacaagcggttttagcgaaagagtttaaagctcaggttaagcaacttattgaaatgaatagaatcaatgtatctaaaggcgatattggttttaacttcaccgataataacgtcatcaaaaaaatagacgtggataagctcactcagacgcaactgattaatgggcgtctcgcgattgcgcgtctggttatcaataacagcggtgaatgtgaatatgcgattattcccgcgagcgtcgccgataaaatcgcacaacgagatgcggacagtattgtcgtaaacagtgcgctgagtcaggaagagcaggacgaagatgatccgtatgccgattttaaagttcccgacgatttgatgtggtaagtcacattcccgacgtttatgtagaaaaatttctcagagagtaaatatgctgaccgacacatctacccggcttaataaatatatcagtgaaagcggcatctgttcgcgtcgcgaggcggaccgttttatcgaacagggcaatgtctttatcaacggcaaacgcgccgccattggcgatcaggtagtcgcaggggatattgttaaagtaaatggtcggttgattgagccgcgagaagcggatgatttagtgctgattgcgctgaataaaccggttggcattgtcagtaccactgaagacggcgaacgcgacaatattgtcgattttgtgaaccacagcaaacgtatcttcccgattggtcgtctggataaagactcgcaggggctgatatttctgactaaccacggcgatctggtcaataagattctgcgtgccggtaacgatcacgaaaaagagtatctggtgacggtggataaaccgattaccgacgagtttattcgtggtatgggcgctggcgtgccgattctgggtaccgtcaccaaaaaatgtaaggtgaaaaaagaggcgccgtttgtctttcgcattaccctggtgcagggattaaaccgtcagatccgtcgtatgtgtgaatactttggttatgaagtgacgaaactggagcgtacgcgcattatgaacgtcagcctgagcgggattccgctgggcgagtggcgcgatctgacggacgatgagctgatcgatctgtttaaattgattgagcgttcctcttccgaagccaaaccaaaggccaaagcgaagccgaagaccacgggtattaagcgaccggtcgtggcgatcgaaaaaagcaatgagaaagcgcgcccgacatcaagcggtaagcgctttacctcgccgggacgaaagaagaaaggacgttaacgtctgccgcgcgtcggcgtattcgccgaccaggagaatgacgcttccgtatcgggtttatacgcctgcttcttcttcaactggcgggcttttttcgcttcagcctcacgcagcgccatcagcttatcgatgtactccttttttacgctgttggtctcagaattggtcagcggacgaccgtgtgcaatacgggcgcggtccagcaacgttttcagttcgcgctgttcgcgctcggtcatctctttttgggtaatgcgggggagtgccatacgggtgccctcagttagccgatgcatttagtctacggcaatacgcaacgggcggatagcgtgtaagccgggtaagcttgcgccacccggcaatattttaatttacctttgccgtttcgcccgatttttcaacaatcggtttcccggaccagtaaccagccagtagtgaccctgaaaggttgtgccacactgagaacagcgcgccaggcagcgctgcgagcgggccaaagtagattttacccaatgcagcagcaagaccagagttctgcatcccgacttcgatcgccagcgttcgacaggttgactcatcaaaaccgaacagacgtccaccccagtagccgccaagcaggccaagggtgttatgcaggatcaccgcgatgatcaccataaagccgacggaggcgatatgtgaagctgaacccgcgaccaccgcgctgatgattgccaaaatgcacaccatcgagaatgctggcagataaggttttaccactttcactacgcgcggaaacagatggtgaatcaccaaccccagcgtgattggaatgaccacaatctgtagaatgctcagcagcatacccatcacgtcgacttgaatatgggcatcgacgtacaggcgcgtgagtagtggtgtggcgaccacgccgaccagcgtggagaccgatgaaatggtgactgagagcgcgacgtctcccttcgccagatagatcattacgttagaggcggtgccgctggctacgctaccgaccagtaccatcccggcggacagatctggcggcatcttaaacagcaacgccagcagccatgccgcgagcggcattaccagatagtgcaggaatatccctgcggcgacaggggctggtcgggagagcacgcgtttaaagtcgtcaacgttaagatggacccccataccgaacataatcaacatcagtagtgtcgcgacccacggcccaacaggagtaaaggtggatggtgtgtaatacgcagtgagagagagcagcagcgcccataacgggaacagccgggtaatgacggcgagcatgttgttttccttgcaagtatgttgtgtttgttatcaacgggtcaggatcgagccagaccatagttattgtttatcgcgtgaaggaagattattcaaacaaattacgctcatgatccagtgtgggcacgtggcaggctggatgacgcgcctgcgtcgccatccggcaacgtatcgcccgatggcgcttacgctaccgtattagaaatatatagaggttctggtggcgtaaagaaaagcgccggcattgaagagaaggaagctttaacgcagtgataacttatattgtttcactttgctttggattgtgttttttaaactaaagtaaggcacccagggcaatgctgtgttccaggggcgaggggaaccatgaaaacagactatgcttgctccgtcaggtaattttccattacctgtcccatcgtatagttcagggttaaaaccaatcatttttggtgttgctatattagctttgtaactaataattcttccgggtaagatgttttgccatctttcagcatcttgacatattctgccgataaatccttgatcgccatgatagggtggggttcttatggcattgatttccttttcaggatttttcataaattcatcccacacatttttttttgcgggtgcaggaataaacataatacctgttgctggcgcaactgaagcaccatgctgagaaaagtcattaagtaatgttatttttttcatagttgtcagaggagtaatatctcccacaataacgctatctatatcaatatagagaatatcctcattaccaagaacaggatgcagtggattgaaaagttctagttttgcccaccatcctggccaatcatacaaaagaggcgctgtatttaccccttttatctttagcgcatctgttaaacaaacagaatcataacctttgagctgcttatgtaaccattgagcatgttttgtggtgaagtctttgctttgtctgagcacagaaacaataatcattatattccccggtgaatattaggtgattttagccatgttccactatatttaatgtgctttatattgcaacaaaattagtgttcatatggttatcgaagttttattacattcaagatgtgaatgtaatttatttgtttataatgttattaatatatgtaatgtaagttgataaatgttttaatgattgttttgtcttttatattttcatggggatatataaaataagagttgggatgggagtgatcttatttcccctttttactgctcccagctctatatcaattccaaatttggaatttagcttgcgattaatccataatccagtttttttctgtttttttgaaccatagatatacatctcatttgccagacgccaccaaaataaaaaaattacgacggcgattgttattggcctgcataagtaatcgatataataaaaattcattactgcgaataatctcatgtcgccagtattcccgtaatccatttccttttttagatatggaaaataataagcaatgtaagagtttgattttttcttcctccaatgaagaaagctatcttgttaaataagtgttattatcgtagggggttcacgtatcaattggtaaaaatactataagatggttttttataatacttcatttgctatgcaaactgaacatttgatgctaacaaataataaagggtattattttaattcaacaccgccgggctttatacccggcgagagattcaacaatcgtattgccagctactgactaaggcataaaggtggctgggggagtagcgccagctatcgtttagtccgagaaattcagcgcaaaactcgctgcaaaacagtctatctttgcgctcccggttatacagcgcgataccgagcgcgccctgccagtcatagcgtttgccgttatgtttgcggaaaaagacttccacttccggcaacgtggcctttaacggtagcttatcccacttatcgtccggtaacggtattatctttccccgcacgccgcgatcgcgaaacgacgcggagtagcagaggtattcattaccgccgtgcgccaccgccagttcacagtgagagtagataccgcgcgtgactttgcgcgtgagccagtcggcaaacctggcgatgccgcgatgctccgatcgccccttatagcaggcgagccagacggtggtttgactcatggttgccagcctgtggagtagtcgtaatccagcaccgcttcgatatcctccagcgcctccaccgccgcaatatgccgctgcgcgttggcaaacaggcgcatatcgtgatccatagtgacggtttcaaactgcgcggcgatgtcgttggtcagttcaatcaaaccgttatttttggcctgccacattaaccctgccggaatctgctgtgcctgacccattctggtgagtgacatttgctgaatacggctgttagcatcgctgtggaaatggttgccgtcgataacgatataatcggcggtaacatcatcacggtgagctttgattgcctgtataacttgtgcttttacactttcaagtgctgagacaaataacgcttcgtcatatacccactcgtttccctgtaatcggtaaaattttccgggtggcggtgtagtaataaattcaagagggttaaggcacacccaacaatttttatctcttagtcgccactgctcatcatctatagaaattactgagtcaggtaacactacgtttaatgaagaagtatcaatccagtctataacctcaaaggttgccggatggtaatatgcatattgagtcatatattcaccatgagatttttacaaaaccgctagaaccgcgtccaccagcgtatcctgataaggctatatttaagctgttaaccgacgctccaccaccacctccagctccgtagccactcgcattgcttccgttagataaaactgcgccagttcctcctttcccaaagaaagtagtttcagcattaccacctgatatagagtccaactggttaaaaccgcttaaaggtattcttgactgaacaatgcctcccgctcctcctgcccccccgttggcgacaacatctataaaaattgagtttccaccgttgatcccagaattcccagcctgtcctacttgcaccacgtttccagtagggttgctattaggtaatacaccaccagccccactagcgcccccagcccccacggttactggataattatttcccgcaataacggggacaatagcaatctctggctctccacttttgccagcattaccacctgaacaatagagaagaccatctgtattactcgtatgccctccacctccaccacctccaccgcctcctaacatttccacaaagacctgagtcaccccatcaggtaccgtaaacgtaccgttagccgtaaaaaactgataatgggaatgattagccggagccgctgcgctcgccttgtcatacgccgcctttaccgcgctcggcgtcgccgcctccgtcgtactggtgctgtcggtggcgttattaagcttcacgatccctttttgcgtcagcgtaccgtccggggcgccggtgatctgcccccaagcgtgtgtatgcctagccggagccgccgcactcgccttatccatcgccgccttgaccgcactgggcgttgccgcttcggtggtgctggtgctatcggtggcgttattaagcttcacaatccctttttgcgccagcgtgccgtccgggacgccggtaacctggttccagacgtgagtatggttcgccggagctgccgcattcgccttatccatcgccgcctttaccgcgctcggcgttgccgcttccgttgtgctggtgctgtccgtcgcactgttaagcttaacaatccccttttgcgtcagcgtaccgtccggaacgccggtaatctggttccaggtatgcgtgtgattacgcgcttccgccatcgccgcttttaccgcctttggcgtagccgctttggtttcgtcatcgctgtcggtggcgttactgagctgcgtaaagcctttctgcgttaatgtcgcatccgggtgatttgtcgaatgttcatgctcgtccagccgggtatccacatagtcgcgcgtcgccagcacgatgctcggatcgaccgtcagcgtcaccgccgtggtgttggagacttccataatcaggcggatacaaacctgcttgccacagccgcccggcagcagcggtttgtacgactcagggaatttgccgatggcgatcagctcgccctcgtcgtcgaacacgcccacttcacgcacataccagccgccaacgtcctccggcagcaccagttcggcaatcagccagttgggattattcggcgcaaccgtcagcgtattcatctcgccgcgccagacttcgtggcgtaatttggtctggctggcgatcggttcataatattgcccaccaccgtcgccaaccgccatcttttgcagatgtagctgttttttatccgcaagggcgctggcgattttcgccattcccctgtcggtcaggagggtataaaactcattatccataattactccgggtaaatagatgtaatttcaaggctccattgccctgtaccgaaatagatcggtttagtttgttgaacttccagaacctggaagggtaagacggtcgttatttctccaccgtaaagcgcgctgccaataacaggaatagcgctttggttaattatccagacaattaacgcttccagttttgaacgcacgttcttatattcatgaataagatcgaccagattattaaacagattttcatccatgccctggttgattagcttaatttcaaccttgaagaaataagccttaccgccatactcaaaccattcggaaatcgtgccgggtaaggataatatttccagtacgcggcgaacggcccagggggttcctttatatttatgcagttcaatcgcctgcttaattaactctcgtttctcctgttcattggcagcaaatagccagccttcgagcccctgtacatgaaactgttcggccaacgagggcaatgccgaggcatcaacgatatccaccagatagaccagcaacgccgtcaggtcgatttgcgcgaaacgttcggcggcaatgttcgccagaattgagaaacgttcgtcgctggccagcggcggcggcagaagcagtttatccatcgctgactccggcaatcgtcacgtcaatagccgtacattccgcccattcgtgcgcctgcaatacctttttcgcgggcatatccagcgcgacgtcgtaaacgccatccacttgtagcactttaattatctggtttggcacaatgtcctggcccagccgggtctggcgcgagcgcgtccatgtattaatcgcttcacgcgcggcggcaagcgtcgtctcctgatcggcggtggtaaacagcgtcagccgggcgctgatctgataagccacgcgcggagaacatttagcgctcaccttatcggttagcgggcgctttttctctttgctcacctcccgttcgatctgggcaagaagctccggccccggcagaccgttcagggtcagcggatagagttccacgcagccttccgccagcccttcatccggccccagtaccgccacgtcgataatcgactggctgaccgagagcgtatggaagcgataggcgccatagctgcccgcgttgctgaaactttccggcgctagctggatgcgtttacgtagcgcgtcgtcgttctcttcgccgcagccgccacttgaggccgtcagattggtgacgctgatatcgtaattgcccacgcggtctaccagcgcgctgatttgcgcaggctgccagttgttgccgggttcaccggtcactacacaggttgcagttaccgcaacgctcaggctgcccgcaggcaacagaacatcttcgtcggtggcgaacatcacgctatccgacgcgctggcgcgggtaccctgtggaatcaccaggttacttttagccgcttgagtaacagaaaactgcagcgtggtttttgccgcctgagcgggcagacggtgaacgccaaccagctcgcctaaataatccagcatcggcgcacgggaatacgcgaccaggttttgcttcgctgcctcctggatggcgatgcggacaaggttttcacgataagcaaacaggtcaatgagcagccgctcagcctgcgccgggtagagttttttaccgctggcttcttcatattgcgcaatcatctcgctggtgatttgcgcggggtcgcggtcaataaagtcgggttcggctatcgccataacacctccgttgagttaattacgccgtctgcggcgcgccattgcacgcgtaacgtcaggtgttcgccgtcaatcgtcggcgtcaccttcagcaaccggcagcgaggttcccacatgcgaatcgcttccaccgattcgcgaacaacgtgcggaatggcccgctcgatcgggtaatcgatgtagcgccacagattgctgccaaaaagcggcctgtggggatcgctgccgcgcggcgtgcgcagaatgatgtgtattgcctgatgaatatcatccagcccgcagacgtattcttcaggacgttgcaaggcaggttgccagtgcagggtcgagggtcgtgttttcgtgttcatgaggctattttcgccttccggcggggggagagatattaaagcgctttaaggaaataattgatggcggggtcagaatgtgttttgcccggtggcgcttctgcgcttaccgggcctgtgttgatgcacattttgttaaatggcgaagatcgcgttttacgtaaagttaaaatgaaattgctgtaatttcacctttgtctacagaagcgtagtaccagaattcatcattgatttctgcgtgcttcattttctcaactggaatcgttttctgccgtccattaaccgagagtgtgatcgaacccgttagctgctcccggctgataatagcgaaatccccgcgggtgttgctataagccgtcgtttcattggaaaggctgtgcttcgctccattagcgattacagaataatcaaaattgactttctttttgaaaatagcttgtacatgataatactcgccgtaaacagcaggatcatggaataaaccaaaatgaccaccgctattttgcaacttgacgaaataatagtcagggatgataaacttctgtttacctgccgctatttctttagtaatgattttttgtcttacgatttcctgtccggccgtttttttataaccgttaagcatcaatgaataggaccaaaggaatacgataccacagagaacagtcacggcagttacgccgacgactccagccttaacgccgcttttcaacagggcgtaagcgatgaaggagatagctaaaaggaaaaacataaacgtaccgttcataacccgatcggggtaggacggcgacgcgaacatgattaaggaagtgccaatacctatacatacgactaacgcagcgcagataagggacgttttatcaattttggcgcgaatctgcttattgaatatgaccagtaagaccagcaataacaaaacaacataagctatccagatcagcgccagatggttatgaacgcgttctgttaagtgaatgaaaatacgttcaaaaatcggccttccataccagaattctttgccgctggcgcggatgaaattgcccggagaaagtatcaatacgcatgaacctgcgattgcacagagactataaactatcttattgcgcgaaacagatttgttttgccataactcgtatgcaatggccagaacagaaataagcgagacgaaaggtgagacgctttcattggaacagcctgccataaagcttagtaatgcaacccacgggctgatcgctttactgttttttattgttatggtgtaaaagaagaacagccatgcaacaacgaacagattcgtccacaaataattcgcagcaccaacgatccagaaagtggtttgacccaaattcgggttcgaaatccagtaagtgaagaatattagtgggaataataagtagtcggatttattccagcgtaatgtacctgagggtgtcttcacaatgaaataacaaaataccagtgtcgaaacggctgcgctgatggaatacacgagttgagaacgtgtatacaggatgagtgcgctggtgtaatcagctataatcctgccactccatgtcatataatgatgaaaatgtgattccggcgaaattcctaaaaggtaatagcggtaatcatcagagtgaataggggtataccattcaataagaaaaatggccaaaaaagccagtagtatcatcgccgttttcggtaatatcttgagcatagtgttcattattccatcattgtttttttgtttttcacgatatagcggggtctttgcttcacctccgtgtaaacgcgtccgatatattcacccatgatgcctatgccgataagctggatgccgcctaagaagagaatcgcggtcataagcgaaggataaccaggaacagggtttccccacatcaatttatcaatgatcatccacatggcatatatcagggagagggcagaaacgctcactcctatatacatccagatacgcaaagggaaagtagaaaaacttgtaatcccctccagcgccaggttccagagtttccagccattaaattttgagttacctgcgacacgttcagcacgggcatattcgaccacatctgtttgacctccaacccatgaaagtatacctttcatgaaaaggttacgttctggtaatagcttgatattttctacaatctcgcgcgacatcaatcgaaaatcaccgacattctcttcaatctttggcgtactgattttgttatgcagcctgtagaaccactcagcgcttttacgcttcaggtggccatccgttgaacgatcgatacgcttagccagcaccatttctgcaccagcctgccatttattgatcaaatgtgggattacttcgatgggatcttgtaaatcaacatcgatagggatcaccacatctccggtcgcgtgatctaatccggcaaaaagtgcaggttctttaccaaaattgcgggtaaatgagatcggaacaacaagaggatcggcaacagctaatgcgctgatgattgattcagtcgcatcgtgactcccatcattaacgaagataatctcaacgttataaggtttaagtgaactgtattctctgaccgttttatagaaaatagggatcgcgtcctcttcattaaagacgggaaccactaatgaaattttcatttctcattcctgaaaacaatgaatctggaatataaaaatccgcaaataaggctaattgcggaaaatacaatgagcgtaaaaatgggaggcatagcacacttgtcgcctgtccatcccacgacggcgctcagcacgcccataaaaccgacgtacagcaaataacgtccggttgatacgctggctccaaaggtaaaccgggcgttagcgaaaaaactaaaactgacagcgacagcaaagcccgctacgtttgccaaagcctgacttgtttgaaatccatagacgcaaagggcaaagatagcccaatgcaaagcagtattaagtacgcctatcgaaacgtactttataaataattttatcattatagcaatcaagaagttgtaattcagcgaagtctaccagacaaaactgagaggatcattcctgaacagcagattttatgtaaacagggcgaagttaaagtaaaaaataacgctagttttccaatatacatatatgcaatatttgcagcgcaaagtgattacattttcatcggaaatagcgcgcgaaaagggactaatcacgttgcgctgaaaataaatatcctccagcaatttgcccggtggcgcttctgcgcttaccgggccggtgtttatgcaccttttgcaggctggataaggcgaagccaccatccagcagcaatttgcaggttagtgagagtggtggttagagttgccgccgttgtccatcagcgtgccgctggcgttaacgttgccgaggacattcacgttgcccgtaatcaccgcgctgtttccgacgccgccgctgcctgccataccgccaagccaggtgagttttttcatcacggtaacgtcgccggtaaaggtgctgagcggcgcatcgacggtgacattcagcgctttaatgcccgtatggggcgcttccacgttgacatctaccgccttgacgcccacggaggtggccgccacgtctacggtttctgatatcaccgtgacgtgctgcgccctgacctctacttgcggtgaagtaagctgcgtatgttccttcacttcaatgacgattttttctatgccgccgttgacggtgagctggtgtaacgcacggtcatattcaaaggccgcgccgtcggaaaactgcacgtagcgcttgtcgcgcgaggccagcggcgcggtatccacgctggagtagaccgcgcccagcaccaccccatcctcgccgttgtcgtcgagcgaaacttccacctgttcgccaatatccggcaaccagtaatctttgttgtcctgcgtgttgcgttgcagcaccgcaagccagttactgcgcaggttatcgcactccggtagagtgactctgacgcgcacgaccgcctcatcaatatcgctgataatacccgtctggcgggtaacgcctttcatattgcctccttactggctggttgccggtccgcgtgaaatgtcgatttcggtagtgtagccgccgctgcgcgtgagtttgtgcatggatttatcaatcagccactgcccggaaagtacgccaaaatcgctcagttctatcttgttgcccgccgtcaactgcgggcagcccatcaagctgagcgtgccggtctgctggtattcgttgtggctgtccagcgcggcattggctttagcctgcgccgcgccggtatccggagcgcgactgttgatcttcagggtatcggcgctggtcgccgcaccgcgcgccgaggtcttttcctggctatcatgggtataaataaccagttctttttgcttgctattttgatgctgcacggtggcgtttttgtagatccggttgatggtatctttgaacgtgtagtgcgaaacatccgtccgcctgagcgtcttcaccggcgccagacagcgcagcgtcggcagatgcgaaaagatcagctccgtcgccgtcactttcacggtatagccatattcactcgccagccgtttgagaaacgctacatcggtttcggcatattgcgtgacccgatcaatcgtcagcggcgcaatcttgcccgccagcgttaaaccgtgtttttgcgcgatgcgactggcgatggcggaaagcgtagtctcctcaaagccctggctgtttttggtgcgtagcgctttgctgaccgaggtggcgataccgtcgatattgaccgtcgaaggcggcgcgctgatatcaattttatcaatgacatagattccgcaatcgagcagatcttcgccctggtagcccaggcgcagcgccagcgtgtcgccttttcccggataccattcgtttacccagcgcccggtgctatcttccagcgcaatggcaatgacatccgactcgtttttaatactgtcgctgtaactgatgctggtgacataaggcgcgatgtcgtaagtgatctctttatgtccgtaccaaagggtaaaaatgggcgtcagggtggcgaacaccccgccggataccgttatctcagccatggcggtagctccggggtcgtttgcgtgacgctgataaccgggatgatcagccgcacgcctgacggtaaaaccggcataatagcgacgtgcggattggccgcgatgatgcgttcgtaggccagcgcatcgccgtaatagcgccaggcgagattatcccagcgttcgccgtcggtggtgacatgttcaaggtagcgcattacagactcctcgtaatatcggcagcggcaagctggctcacgtcaggagcgcttgtttgcagcgtgccgcgcgcctgattgaccagcgtcgcggcgctgtcgtaagtcgcttccgcgacgctgctggtgatagcgtcaaacagcgattcggcgtgttcgataagcgtgccggcatcgcccgcgcattcgcggatccccggcaggctgtcgatcagttcctgcattttcgccgccagcgctttcggcagcccggccagcgtttgcaaatccagcggctgctggaacagcgcgtctatcgaactcatggtttttttcagcgaatcgacgatatcgccgcatttttctttcagcgctttggcttccttcaccagttctttcgcctgggcgatcgtttttttgatgtcatcaatggcgtcggccacctcatccatcatctctttggcttcacgcataccctcttcaacgacgctcagcagttcatcgaaccaggaatcgttaacgtcgggaagctcatccaacatctcgtcaatgttcggttcctgggtggtgatggccggaggcagcagcgggctcttcggatcgccggtgtactcctgtagcgacaaactgccgccctgggcaatgacgttaccgtaaggatcggtgtgttggtgggtagcggtcagatcggtaatcacgaaccagccgcgataatcgccgttgccgaacaccagcgccatcgcctggtgcgcggtcatcgcttcccgcagacggttcagctcggtggtcggctggcaatactgactatgaaagttgaatttcagggtgattttgtccagcttatcgccgataaattgcacgcccggtttcccttcaatacgggcatggctggtgtaatccacgcccatcgtactttcaaattcgtcccagtaagcgacgacgtcaaattctatttcgcctaatacggcatacattatgcgtactcccggcgccgttgctgcgccatgacatcgttaatcattctctccagctcgcgtttgctcagcgacagcacgttgttgatatctttggcggcattcgcgccgcttccctgcacggtaacctgcggggaaaagtgtacctgcacgttgctttgcgcgcgggagggcagcgtataaggtttcccgccggatttgccgggaagcgcggctggcgtcggcggcgtggcggcgcttttcgtcttcacaggctgcggcgaggccatcgttttggccgaggttgtcaccgctttcgctcccgatgccagcggcgcgctggcctgttgcgcgaccattgttccggcaataccggggacggcggcggcgacagacggcatttcagcgctgatgcccagcgcgcttttcgcccagtcggggatcagcgcttttatcttctcaatcgccccgctcaggaaaggaagcgcattcagaatgccgttgatcaggctatcgagaatattgccgccaaattcgctgaaactggcggggagttcaatgccaaaccagtccagtacgccggcgaaggcgcggtaaaacaaccccagcggcgaccagtcgagaatcagacgcgtgacgccggcaatgcctccgtcaaaggcggttttgatgcgctcccagactccggcaaagaaaccggaaatcggttcccagtagcgataaagtaaataggcggcgcctgcgatagcggtgatagtcaggccgacagggttcatcagcagcgcccgacccagccagataaacgtctggccgaccagccgtagcccttttatcaggccgtttcccagcagcatcgtcaggcttttcgcaccgttgccaaacgatttcagaaccgacagcgcgcgactgccgccgcccagcgccagaccggctttgaccttcaggaagatatcgatcaggcgaataaacggtgacgcaatgaggtttgctcccagcctgagaatattcagcgccccgttgaacagccagataacgctaacgactttagcgaccccttgcaccagcgccggattttcccgcagccaggcgctgaactgccgcaccagcggcgtgatgctttgcgccagttcgccaatggcgggcatcagttccaggccgacggtcagccacagatcgttaagtgaaagttgtaacgctttggtctgttctccgggcgatgtcattttcgcggcgaagtcatcatcaataacatgttgccccgccgcctgcattgcggaggcttttagctggcgatattcgtccatattcgccagcatcggggcgagaaaatcccgcgtttgcgcatcgccgaacatcgcgccgaggttaaatttctccaccatggcctgtagcgcgtcgccgcgcgcggaaagatcctcaatcttcatggtttgcctgaaggtgtcgaggatctgcgggttcattttctccagttgcatctgcacgatgtgggtcatcgcttccgtcacgccgatcccattttgctgatgctccagcagcgatccctgaagatccacgccctggcgggcaaaccaactgtccgtctctttcgagaaggcggatttcaggaaatggtcgaaattcgctgccgccgcgcctgcgtcaggggcatttttcatggcgatttgcatcgttgcggtcagttccgcaatgccttctttcccctgagcgccggtttttccggcaaaggcgttaatccactgggtttgctctgcaacggagccgccgccgctttttgccacgctgtacagcatattttgcgcaaaacggaagtcgtcaggggcgatgttcagtttgtcgcgagtggccagagccgcctgcgcccagctttgcgcgctgtcgcgggaggcggtcgcggctttggcgatatcgggcatgtagcggctaagatcctgcaatgcgctgacgccgccttcgatcatcgtggcggcggtgctttgcagatctttttgatcttgattgaaatcaaggctccagtcgcggatattcaggctcagggcgtcccgcgcggtgttatccatgccgcccttcgccgccatatcgaccatgttgccctgaaattcgtaaggcagcttccagtcgggagtctcaacgttcaggagcttgccgagctgtccggcgaacgtttgtgttttttccagcaacccggcgcgctgtttatcgttctcttcccggcgaagggcggagttagcgagctgttgcgtaagccgggtgacttttgtttgctcaaagctgagcgtgtgcagcgtgctggcgttgagtgagccgtaacgggctattgcctgcgtcaacgtctcattacgcgcctgaagctgggtaataatgtcgttggccaaaatagtgtctcgtataagttgcccggtaacaggctgcttgccggaaaaaggacagggaaggagtgaaccgggcttgggtcaggaaacccgcaggcattaagcctgcgagtcgtattcgtgtttaatttgcgcgctggcttcgtccagccagcaggtaaaatcgtcaaccgacagcgcgtcaatttcactgggcggaaagcgaaaccacctcgccagcagcgccattgcctgccacagttgctgtgggttctgtagccatgctaagcatggactgaaatcgtttctgcaatgcctgatagtccagcagatccatttccgccagatcttcggttaccagcccggtcatagccgccatcagcggctcatcccactcttccggtttatcgctggcgcgtcgcgcggcgcgcatatcttttaccttcaggcgacgtaattgcagaacgtcgatacgttccccggcggcggaggtaaacgggaactgcagggtatatttttcgttcatggtatagtccttattcgtcgtgttaaattcggggccgtagccccgaagtaattaaccgccaatattattgcggtaggcatttaattgatccgcgccatttacgcggaaaatattcgccagataatccagttcaagaagcgtttcaccgtcaaccacctgtttaatataagtgcagccgaaggcgctgctgaattccgggttttcattctgtttaaacgttcccagcgggttctttttaaacattacggtcatatgcgtcaccagcgctaactgatccgctttaccctgcgagttataacaatcgatgctggagcggcactgcaatgccaccgcctgccacggatttgccgttttacgcatgacgtcgtggtaaaacgagttccatttaatttcaccttccagtttgtcaaaaccggcaggcagttcaattttaccgaccatccccagcgctttatgctcctgcataatcatgctgatatcaggcagtttaatttcactcgcgcgacctaaaagattattaccatcaagataaatattggcgttggtaatacggttaatttgaatttttccagccattagcgattgctctccagagaaactaaatattcagaggtaatttcggtttcaaacgtcagacgttccagcggcggcggcggggtgaatttgtagctcagcaacagatgcccggctgccagttcagtctgttcgttacgcgccgggtcgtaccagcattcaaagcccaacaacgcgccgtcggcaatcagcttgcggccccaggtgttcaccgattcggttagcgcgtcgatcagcgcctgattaatcggcatatccatgtattgctggctaaaatagcgaatcgattcgttaatcacatcaccagtacggcgcacgttctcaaagttacgcatatgagtaaccgtcggccaggcggcggtacggttgccccacaggcgcaaaccggagccatagctgttgaagatggtggtgatgccgttttcattcagttgattcacttcggtttgcggatcgtcgatcatcgctgacagcgagcgctctacgccggtaatgccctgaatttcctgattggagttgctccaccagaagcctttttccagatccactttggcacgcaggccagcggcgcgagaggagagcggctccaggacttcgctgttcgtcgcgctgtcgtacactttaacgtgcggatagcacagacgcgcgcgatcggaactggtattgaagttaatcgccccctgcggaccgcgccctgccagaacctgctggaaagtcgtgccgatgggcgcatcaatgtaggtaatggctcccagcgcttctgcctgagcgataagcttaacggcgaccgagttttgcgtacaaaagaccggcgcaatcaggatcttcgcgtaaaaaccaaactggttccaggtgtcctgtaacagcttcatgccggtacggtcacccgccgtgtttaccgcgccaacaatatcggcggcagtcactttggtggggtccgcgtaagtataatttacataggcctgaacgccgggtttcagattggtccccatgcaggtgattttaccggtcagcatatcaatggtgtaatcggtgcctttgatataagcgtttccggcgttcgtgctgcggccaatgttcatcgtttgcacggccccgtgcttgagttgaatctgaccgttgtcatcaaccttcacggtttcactgggaatggtacttttgtgtaccgccggattcagcacgttaatcaccacgaccgtccctgcgccgtgatcgtagatcgccttcagcgcctgcgggatggtgaaatttgccagacctgggccaaactgtgccgcgtcgctttcagaaaggcacagcgttggctggttaaccgggccgcatggcgcggtgccgatcagaccaataaccgcagatttaaccgccttaaccggacgtgggccggtttcgatctcaatggtctctacaccgtgcaggtaattagctgccatggacaatttcctcttcattagtttctacttcttgcgtaaccactggcaccaggtgacggcgggcaatcatggtgattacccactcgttatcttccggcagcgagatttcgctattgggccacagtaagacttcctgaccgtcggcgagcgtgacgccgcttgccgggccactgtagatatatttcattgaatttcctcataattaacgattgtcagcaggggggagtccttgctttcctgttccgcgataaacagggtgctggcggtcatatccagggcgtaacggcagaagtttgcggcgtcgccgatatatttttcgctttccagccagagcggacgatcacagtcgggaagttcaatgccccccaacgagcgacgtagacgatccagcgcgtttatcgcgtcacttatttgcggaacaataacggtggcggaaatccggattagttgtttttgtaccgtggcatccgtattttctggttcggcaaaaaccgaaccgcagtagtgaattaataccgttacctgctgtcctgttgggatatatactttcgcatcggttgatgaaatatgtatatccatatcagggtttaattcacgtagtctattcgccacggtatgtataacagataatgtttccatatacggttttccttgatttaccgggagagataatattctctcttcgttatcgttcagacgtattttgatgtatcaggcatcaggcgtcttttaatctcctttagagaaaaaagttaaaacaaataaaaaatccccggcgtataaacgacggggatttgtttaatggttacctcgttgaatcagttctattttgctatatagcgcatccagttttgcttccagaacggcctggccgcgaagataatcctcgcggcggacataatgcagcggtaaatcggcgcgaaattccagaaattctctctccagcctggaccagcccgcttctgattcgcgccgggcagcttccagtgcttcaaaacgttcattcagccgtttttcaatttgcgccagcagcaatttaccggcagcaaacattaatccaacaaacgaaagtaagagggagatgacttcccaaaaatcgatactgagtttcattactccctctgattaatgaatgcagctagcccgcccccattgcaaataacggggagcatgttggtataaaatcgctttggggtagtgacgattctcgcgccagtttgcggcgctgcgcccggcgttaacgcgttctacatgttcaaaccagatggacgcatccaacccctttgcggcggccagctttttatctctgttcacccagccttgcccgccgttataggcgctcagagtgaaagccattcgctggcagctattttttgctaacacgcttttccacaactggcggtcatactgtaccagcgcgcgtatcgcccaggcgggattaaacggcttgttttcgtggagttccgggtacaactggctcacccattttgccgtcgcaggcataaattgcgccataccctgcgcgccagccggagaaagcgcgtcaggcgcccagccggattcctgatgtagttgcccggcaaaatcagcaacgggggcgttaagcccccagatttcgcgcgcggtacgaatcacttcgttgcgccattgcagggaagcgcgcggcggttcggcagcgtcggcagacaagaaagtcatagcgcagaccaggcatacgtattgataacgcatcgttacagccccagcgcgacggcaaggcaaattgccgcaacgatgatcgcgcgacgaatcatcgccgcggcgcagcacagcgattcttcccaggggcaaaaggagtcgggacgtgcccaggggaaaagactacggtcgagccagtaacccagcaccgctgataacgaaaccaggctgagtttatagatgacgaccggaatttgcgctgatgatgtccagccgataagcgcaaacagtacgacagaggcaaccagccagccggaaagtcggggaacaataatttttcgcatactctatctcctgataattgagagagaagtatcgcttttccccatagtggaagaacgaaaagggctttaataaataactttaaaaaatgtttagcgcatggcgtcaaatgccaacaaataaacgaataaataaagctttcggggcagggggtagaggttgcctgcggagagtcagtatgtgtctgtggcaggctacgatggcggtattgctgcgtcataataatctttgattaaaattatcttattgatttttaaagtcagtttaaaaattcacgcgattgtgaggaaagcaatctttttgatcgaacgcagaaaaaaatgcaaaaaattaactgtatatgcatacagtattgtgtaaaatgatgacatcagtgaaggcttacttcacctataaaataaatacatattataaattgaaaacgatatatatatttttttaatttataattaaatgcgttgatagtaaatatttatatatattttgaatgtattgataggtagttattgcaccgttttttacgcttccctttttggtgccgtcacggggagcatggtgctggatatggagataaaatatgattcagaaatcaaaagaaatggttcggcttccggagattattaacgatctggcgtttcatgcgtcgcaggtgcttattgaaagcatgaatattgatagcgcgtcagccgaaaatgccggtcaggcaattgctgacagaatgatgcgcaactggggcgggcaaagcatttattttcccaaaggtatctctggtcgggcttcggaacgggattatcagatttacagcgagtgcgatgggcgtaattatgcggagctggccaaaaagtacaatttgacactgcagtggatctataaaatcgttaagcgggtccacacggaaaaacagcaccagcggcgtatgctgtaagcgatatcgggtatggcgtatagcgcgacaagcgctatacgccgggagcagcgacaggccggataaggcgcctgcgtcgccatccggcagcgtattgcctgatagcgctcacccgctgccgtgtcagggcgattattcaaataagttctgatgtagcttttgcaccactttctcggcatcgtctcccggcacgaggaagcacagattgtggctggaggcgccgtaacaaatcatgcgaatgttgaacggttccaggacgccaaacacttctttaccaacaccgcaggcttttgacaggttgttgccaatcagcgcgaccagcgccagtccttcttcaacttcgacccgacacagcgcggaaagctccatcaataaggattgggtcagtaacgtatcgcccgtggaggtggagccggtagtatccagcgtcagcgcgacgctcacctccgaagtggtaatcagatctaccgaaatattatgccgcgccagaatgccgaacacctctgccaggaaacctcgtgagtgcagcatattcaggctgtgcagcgtcaatagcgtttgattgcggcgcagcgccagcgcgcggaacagcggcgggttttgggttttattgcacaccagcgtaccgcccgcttgcggatctttactggagccaacgaagaccgggatatcgctacgcacggccgggagtaaggtggctggatgcagtacttttgcgccgaaggttgccatctccgccgcttcttcaaagtcgatttcatcaattcgctgcgcgacaggcactacgcgcgggtcggtggtgtaaataccgggcacatctgtccagatatcaacccgcgcggcgtggagcgcttcagccagcaacgctgccgtatagtcgctgccgccgcggcctaacgtcgtggtgcggcctttgctttcactgccgataaagccctgagtaatgaccaacgtttcgctcaggcgcgggagcaactgctgcgcggccagttccgcaagcgctgcgacgtccggttccgcacgaccaaagcgatcgctggtacgcatcactttgcgcacgtcgaaccagtgggcctgtacgtcgcgttcacgcaggatctcaacaaatagcagggtagacatcagctcgccgtggctgaccagttcatcggtcagggctgccgatgtcgccagcgatgccgcctccgccagaatagtgatgttttccagcaggcgttcaatctcttcgcgaatgacattcggatgacgcagacgatcaaggatatcgaactggattttacggatggcgtcgagcgtagcgaaacgttcgccgggctccatcccttcggccagcgccaccagcaggttagtgatgccggcagacgcggaaagcacgactaaacgaacattggtgtcggaaagtacgatatccgcgctacggttcatggcgtcaaaatcagcgacgctggtaccgccaaatttggaaacaacgatctctgtcatatcaacctcgtgtcaggaaatgaaaaacgcgaccatggcacaagggcagaacagaaaccggtgcaggcgcaaatgcaagtaacgtatttataaataaaagttgtggcctggactgtcaacgttgggattatgcggattttttatgctgagtttaggctcagtaacagcgcttataaccccgatacccatttgccgcctttctgcacctcgaattatttagggtatatactttttatcctcattcgacagtgcctggggcaacggcactaaaacaatcacacttttctgtgactggcgttacaatcgatcccagtcacaattctcaaatcagaagagtattgctaatgaaaaacatcaatccaacgcagacttctgcctggcaggcgctccagaaacactacgatgaaatgaaagacgttacgatcgctgagcttttcgcgaacgatagcgaccgtttcgctaaattttccgcgacgtttgacgatctgatgctggtggatttctccaaaaaccgcatcaccgaagagacgctggcaaaattacaggatctggcgaaagagaccgatctggccggcgcgattaaatccatgttctccggcgagaagatcaaccgcaccgaagaccgcgccgtgctgcacgtggcgctgcgtaaccgtagcaatacgccgatcattgtggacggcaaagatgtgatgccggaagtgaacgccgtacttgagaagatgaaaactttctcgcaagcgattatctccggtcagtggaaaggctacaccggtaaggccatcaccgacgtggtgaacatcggtatcggcggttccgacctcggcccgttcatggtgaccgaagcgctgcgtccgtataaaaatcatctgactatgcacttcgtctctaacgtcgatggtacccacatcgctgaagtgctgaagaaagtgaaccctgaaaccacgctgttcctggtcgcgtcgaaaactttcaccacccaggaaaccatgaccaacgcccacagcgcgcgcgactggttcctgaaaactgcaggcgatgaaaaacacgtggcgaaacactttgctgcgctctccaccaacgccaaagcggtcggcgaatttggtatcgacacggccaatatgttcgagttctgggactgggtcggtggtcgttactcgctgtggtctgccatcgggctgtccattattctgtccgtcggtttcgacaactttgtcgagctgctttccggcgcgcacgcgatggacaagcatttctccaccactccggcggagaaaaacctacccattctgctggcgttgattggcatctggtacaacaatttcttcggcgcggaaaccgaagccattctgccgtatgaccagtatatgcaccgtttcgccgcctacttccagcagggtaacatggaatccaacggtaaatacgttgaccgtaacggcaacgccgtggattaccagacaggcccaattatctggggcgaaccaggcaccaacggtcagcacgcgttttatcaattgattcaccagggtactaaaatggtgccgtgtgattttatcgccccggctatcacccataacccgctatccgatcatcatcagaagctgctgtctaacttcttcgcgcagaccgaagcgctggcgtttggtaaatcccgcgaggtggttgagcaggaatatcgcgatcagggtaaagatccggcgcagcttgaacacgttgtgccattcaaagtgtttgaaggcaaccgcccgaccaactctatcctgctgcgcgaaattacgccgttcagcctgggcgcactgattgcgttgtatgagcataaaatctttacgcagggcgtcatcctgaacatctttactttcgaccagtggggcgttgagttgggtaaacagttggctaaccgtattctgccggagttgggcgatgataaagctatttcgtcccatgatagctctactaacggtctgattaaccgttataaagcctggcgcgcctgatggcactgcgcttatccggtctacgtaatgcatagcgtctgtaggccgggtaaggcgtttcgccgccatccggcaaaaagagaataagataataaaaaggccgatattcacatcggctttttttataagataattccgcttgtccgtctttatccccacagttttatattgagcttaatcctaaaataagcaataaccagaaaatcactctgcgttattttcagattatacggatgctgatgtcttttagtttaattttaacttattgattttatttgtttgttaattaaataatgtaggcgttacttctttaaagtttaattatcctaaaacttcgatgttatttctcccggacataatccgcctgctttggttgtgtatactcggtagcgcccgaaattcttttgggtaaatctccattcattcaatgaagggaagttatgatgaaaaaagtactgtatggcatttttgccataaccgcgcttgcggcgacatctgtctcggcagcccccgttcaggtgggtgaagcggcagggtcggcagcgacgtcggtatcggcgggaagctcctccgctaccagcgttagcaccgtaagttcggcggtgggcgtcgcgttagcggcaaccggcggcggcgatggttccaataccggaaccacgaccaccacgaccaccagtacccagtagtatcggtacgtttaaccataaccacactccggtgtggttattttgcccctctggagaagcgtcgtgaagcgactcgcacttatcctgatttgcctgctattacaggcgtgttcggccaccaccaaaggcctgggcgattcactgtgggacagtttgttcggtacgccaggcgtacagctaacggatgacgatattcaaaacatgccttatgccagccagtacatgcagcttaacggcggtcctcaactgtttgtggtgctcgctttctcggaaaacgggcagcagaaatgggtgacgcaggatggcgcgacgatcgtgacgcagcatggccgtctggtcaaaactctgctcggcggcgacaacctgatcgatgtgaataatctggcgaccgacccgctggcgaaaccaggacagattatcgatggcgcgacctggactcgcaccctgggctggaccgaacatcgccaggtgcgttacgccaccgcccgttccgtttttacatggcgagggaccgatagagtgaacgtcggcagtgaggaaaccgccgtgcgggtgttagatgaagaagtgacgaccgatcaaacgcgctggcgtaatcgctactgggttgatagcgaaggccaaattcgccagacggaacagtatctgggcgcgaattactttccggtgaaaaccacgctgattaaggcggcaaaatcatgatgaaaaggacgataagcgcgctggcgctggcctttgtcgcgtcatccgcctttgccagcggcactgttaccgtttttacccagggtaatagcgagcctaaaacgctgacagacgctgagcgtctgctcgatttagtcggacagccgcgcctggcaacgagctggtggcctgcggcggtgataggcgaagaacaggcgaccgtgacggcgcgtcagcagcaacaggaacttctcgggcggctggcggtgctcagcgctgaggaagacggcgatgctgcggcggcgataaacacactgcgccgacagattcaggcggtgaaggtgacgggcagacaattcgtgaatcttgatcctgacgtggttcgggtgagcgaacgaggtaacccgccgctgcaaggtcactacatgctctgggtcggaccgcaacccacgcaggtgacgctctttggcttgattagccagccgggcagccagccgttcgtccctgggcgggacgtcgccagttatctcgaggatcagcgcttactcagcggcgcggatcgtagctatgcctgggtggtttaccctgatggacgcagccaaaaagcgccggtggcttactggaataaacgtcatatcgagccgatgcccggcagcattatttttgtcggttttgccgattccctttggcgcggcacgccggaggcgataaatgccgacattcttcataccctgacgcagcggataccggaataatgaaaaaaacacatctgctcagcgtgctggcgctgggtattagcgcggcctgccatgccgaaacatatccagcccctgttgggccttcacaatctgactttggcggcgtgggcctgctgcaaacgccgacagcgcgtatggcgcgtgaaggggagatgagcctgaactatcgcgataacgatcagtaccgctactactcggcttcggttcagcttttcccgtggctggaaaccacgttgcgctataccgatgtccgtacgaaaaagtacagcagcgtggaatcattctccggcgaccagacttacaaagataaagcgtttgatgtgaaactgcggttgtgggaagagagttactggatgccgcaggtggcggttggcgcgcgcgatatcggcgggacggggctgtttgatgcggaatatattgtagcgagtaaggcctgggggccgtttgatttttcattaggtctcggctggggctatcttggcaccagcggcaatgtgtctaatcctttctgttcgtatagtgataaattctgttcgcgtgataacagctacaaagaggcaggttccgtcgacggtagcgatatgtttcacggcccggcctcgctgtttggcggcgtggaataccagaccccgtggcaaccgctacgcctgaagctggagtatgaaggcaataactatcagcaggattttgcgggtaaactggagcagaagagcaagtttaacgtcggcgccatttaccgcgtcaccgattgggccgacgttaacctcagctacgagcgcggcaatacctttatgtttggcgttacgctgcgcaccaatttcaacgatttacgtcccgcgtatcatgacaattcacgcccgcaataccgaccacagccgcaggatgccatcctgcaacattcggtagtggctaatcaattaacgttattgaaatataatgccggtctggcggacccgaaaatccaggtcaaaggcgatacgctatacgttaccggtgaacaggtgaagtaccgcgactcccgtgaagggatcgtgcgcgctaaccggatcgtcatgaacgatctgccggaggggatccgcacgatccgcgtgacggaaaaccgccttaatctgccgcaggtcaccactgaaaccgatgtcgccagcctgaaacgccatctggaaggcgaaccgctgggacatgaaactccgctggcgcaaaaacgcgtggagccgatcgtgccagagagtactgaacagggctggtatatcgacaagtcgcgcgttgattttcatcttgatcccgtgctgaatcagtcggtaggcggcccggaaaacttctatatgtatcagttgggcgtaatgggaactgcggatctgtgggtcacggatcatctgctcaccacgggcagcgtgtttgccaatatcgccaacaactacgacaaatttaactacaccaatccgccgaaggactcgcatctgccgcgggtgcgtacgcatgtccgtgagtatgtgcagaatgatgtttatgtgaataacctacaggccaactacttccagtattttggcaatggtttctatgggcaggtctacggtggttatctggagaccatgtttggcggtgccggggcggaagtcctgtatcgcccggtagacagcaattgggcgtttggcctggatgccaactacgtgaaacagcgtgactggcgtagcgcgcaggatatgatgaagtttaccgattacagcgtgaagaccggacatttgaccgcatactggacgccgtcgttcgcccaggatgtgctggtgaaagccagcgttggtcagtatctggcgggcgataaaggcggtacgctggagatcgccaaacgcttcgatagcggcgtcgttgtcggcggttacgcgacgattaccgatgcgtcgccggatgaatatggggaaggggattttaccaaaggcgtatatgtttccgtgccgctggatatcttctcgtccggcccaacccgaagtcgtgcggcaattggctggacgccgctgacgcgtgacggtggtcaacagcttggccgtaagtttggcctgtatgatatgaccagtgacaggagcgtaaatttccgttaatactcaggccggataaggcgtttacggcgctatccggcaaattatcttattgaacaaaatataaacataaataaaaaatatagatgcccgtcacatttgtgcgttatacagaaacctcgccgcagagaaagagggggctgttatgatgccattatcgcgctcacgtcttgagtttatcgccacgattttacaaaacgtactaaatttggggctgcttaccctcggtctgatcctggtcgtttttctcggtaaagagacggttcatctggcggatgcattattcgcgcctgagcaagccagcaaatatgaactggtggaagggctggtgatctactttctttatttcgaatttattgcgctgattgtgaagtactttaagtctggccttcactttccgctgcgctatttcgtgtacattgggatcacggcgattgtgcgtctgatcattgtcgatcataaaacgccaatggatgtattactctattcggcggcgatcctcctgttggttatcacgttgtggttatgtaattcgaaccgactacggcgagaataggcgtcgccacaccgtaacggacgtatggcgtggcaataaattagccgctgtctataacgcataaaaaaagcgctccgaagagcgccaaaatacgaccataagtggggataacataacttgagggcagtggcattgcccgttgccgggcaggtacttcgataaaacttaacctttcacaccccctgccgtcaggccgttgaccagccaacgttgcgccaacaggaacaccagggtgataggaatagctgaaaggacggcggcggcggcaaagtcgccccacaggtagttttgcgggttgagatattgctgcatacccacggccagcgtatagctgtccacatcgcgcagtaacaacgaggcgaccggaacttcggtaatcgctgcgatgaacgacagaataaacaccaccgccagaatcggtacggaaagcggcagcagcaccaggcgaaacgcctgccacggggttgcgccatccagcgcggcggcctcttccagcgaactgtcgatagtttcgaagtagcctttaatcgtccaaacatgcagcgcgatgccgccaagataggcgaagatcacgccgccatgcgtattcagcccgataaatggaatgtattgtcccaggcgatcaaataacgcatacagcgctaccagagacaaaaccgccggaaacatttggaaaatcagcatccctttgagcagtgttgctttacctggaaaacgcattcgtgcgaaagcgtaggcgcaggtggtggagagcgccacgatgccgatggcggtaataccggcgattttcaccgagttccacagccacagcaggaccgggaagggaggcggcgttacccgaccatccgcatgttccacgctgaaacccagcgccagccgccagtgttcccaggagattttatccgggatcaggcttccggtggcgaagttcccttcacgtagcgagatagcgatgaccatcagcagcgggaacataatcgctgcgatgaaaatcagcagccccaggtgcgtgatgaggagacgcagtttctgagatttgggttggaccatagccattgttattatctcccttaatcaaacttcatacgcgtggctttcaggttcactattgccagcgcgcctaccagcaggaagatcagcgtggcaatggccgccgccagaccgaagtcctgaccgccgccgccttcaaaggcgatacggtaggtgtagctgacgagtagatcggtataaccggcaggcgtggtggtgccgagacggtctggcccgccgttggtcaataactgaatcaggacaaagttattaaagttaaaggcgaagctggcgatcatcagcggcgttagcggcttaatcagcagcggtaaggtgatcttaaagaaattctgaaatggaccggcgccgtccattgcggaggcttcgtacaggtcatccggaatcgctttcagcagtcccatgcacaggatcatcatgtagggatagcccagccaggtattcacgataatcaccattgcccgcgcggtgttggggtcgctgaaccaggcaggtttaatgccgaacagcgcgctcagcatcatattgatttcaccaaagctttggttgaataaccctttgaaaatcaaaattgaaataaacgacggtacggcgtagggcagaatcagcaggacgcggtagatagctttacctttcagcgcttcccactgtacgaggcaggccaataccatcccaaccgccacggttaacaccacagtgaggaccgaaaagaccacggtccagacgaagatagcgaaaaagggcttctggatcccttcgtcggtaaagacgcgcgtaaagtttttcgcgccgatagtaacggtataaccaggactgagtttttcatcaccccagcttccgtcggcgttgatcgactgataataaccgctatcgttgtttggccggtattttacgccgctctggttattggtcagcaggccgtcatcagccagtgtgtacagcggacgggtaccggaaaactgacgcagcgagctcataatcactttactttcatccggcaggacggcggttatctggttcaacgccagacggttctgggtgattattcgcagattggcgcgttcgccgcccggcagggcatcagtctctttcagctgtaatttttgttcgccgccgaaggaaaatgcgtcagacaggtaatgtttgcccgtttctccgtcggtgagggccagttgccactcgtcgccggtcgggtaaagaccgaagttataggtttttcctgcctgataagaacggtccatcagcacttgctgggcgcgttcaaaggtgagctggttggtgctgctgtagttagtaaaggcgatagcgatggtgcacaccagcgggaatagcacaaacagccccatgccggcgaggccagggtaaacgtagcgccaggcgtaggttttacgatttgcgaaaatatacaggccagcagagcttaaaatcagcgtcatgatggcgaacagatactccccttgtacgtacattaaaactacaaggtaacccaccagcaggcccagcagaccaattactgaccatttaagctggtcgctttgccaccagtgtttctttttaatgacatccatgggggttttcctctacagcgttgaaacttcctggccggagatgtgcctgatggcgctgcgcttatcaggcctacggtgtgttgtaggccggataaggcatttatgccgccatccggcacaggctcacggcattacttagtgatacggctttgtgcatctttcagcgcggcatccacggtttgacggccgctggcggcgttgatcacagccgtacgtaccgcataccagaaggcggacatctgcggaatattcggcatgatctcgcctttctgggcgttatccatggtggcggcgatacgggggtctttcgctaactgctcctggaaagatttcagcgccacggcgcccagcggtttatctttgttcaccgcttccagaccctgatcggtcagcaggtagttttcgaggaactctttcgccagctctttattcgggctggcagcgttaatccccgcgctcagcacgccgacgaacggtttcgagggtttacctttgaaggtcggcagcagggtgacaccgtagttgactttgctcttgtcgatgttcgaccatgcccacggaccgttgatggtcattgccgtttcgcctttattgaaggccgcttcggcgatggagtaatcggtatcggcgctcatatttttgttcttgatcatatcgatcaggaaagtcaggcccgctttcgcgccggcgttgtcgacaccaacgtctttcacgtcatacttgccgttttcaaatttgaacgcgtaaccgccgtcagcggcgatcaaaggccaggtgaaatacggctcttgcaggttgaacattatcgccgacttccctttcacttttagctctttatccagcgccgggatctcttcccaggttttcggcgggttcgggacgaggtctttgttataaatcagggagagggcttcaacggcgatggggtaggcgatcagcttgccgttataacgtaccgcatcccaggtgaacggatagagtttgtcctgaaacgctttatccggagtgacctccgccagcagaccagactgcgcgtagccgccaaaacggtcgtgcgcccagaagataatgtcaggaccgtcgccggtggctgccacctgcgggaatttctcttccagcttatccgggtgctcaacggtcactttaatgccggtgtcttgctcaaattttttaccgacctcggccagaccgttataacccttgtcgccgttgatccagataaccagtttaccttcttcaattttggcgagagccggggcggaaatcatcatcgtcgtaagtgcggataatgcgaggatgcctacgccagttttaatcttcatatctcccatcctttttggtgatgtacacagaggtggtttaacggtctctagtttctttatacgacaacctctttccatcctccccgccccaacgccccaccccggctttatgtgatctgtgttgcataaatgtgagtaatgcgtgctggcgcacacaaaaacacgccgatttttgcgggcggcatcacgaaattccttttctgtccgcgcccgtggtctcaggtgttgtgtcctcatcctcccgcctcctcccccataaaaaagccggggggtggaggatttaccccagtcagggatcgcgcatagtcaggccatcatgaatgttgctgtcaatgacaggttgtaacgaagggagaagggcatggcgagcgtacagctacgaaatgtaacgaaagcctggggtgacgtggtggtatcgaaagatattaacctcgatatccatgacggggagttcgtggtgtttgtgggaccgtcaggctgtggtaaatcgaccttgctgcgtatgatcgccgggcttgaaaccatcaccagtggcgacctgtttatcggggaaacccgtatgaatgatattccgcctgccgagcgcggcgtgggcatggtattccagtcttatgcgctctatccccatctctccgttgcagaaaacatgtctttcggcctcaagctggcgggcgccaaaaaagaggtaatgaatcaacgcgtcaaccaggtggcggaagtgctgcaactggcgcatctgctggaacgtaagccaaaagcgctttccggcgggcagcgtcagcgcgtagcgattggccgcacgctggtggcggagccgcgtgtgtttttgctggatgaaccgctctctaacctggatgccgcgctacgcgtgcagatgcgcattgaaatttctcgcctgcataaacgtctgggccgcacgatgatttacgtcacccacgatcaggtcgaggcgatgaccctggccgacaaaatcgtggtgctggacgccggtcgcgtcgcgcaggtcggtaagccgctggagctgtaccactatccggcggaccgttttgtcgcgggcttcatcggctcgccgaagatgaacttcctgccggtgaaagtgaccgccaccgcgattgaacaagtccaggtcgaactgccgaatcgccagcaaatctggctgccggtcgaaagtcgcggcgtgcaggtcggcgccaatatgtctttaggcattcggccggaacacctgctgccgagcgatatcgccgatgtcaccctggaaggcgaagtccaggtggtcgagcagttagggcacgaaacacaaattcatatccagatccccgccatccgtcaaaacctggtttatcgccagaatgacgtggtgttggtagaagagggcgccacattcgctatcggcctgccgccagagcgctgtcatctgttccgcgaggatggcagcgcatgtcgtcgtctgcatcaagagccgggtgtttaaggcctccataaaaaaacgaaacgcaaaaccattcgcagttttagaaggtggcagcgtttaaagaaaagcaatgatctcaggagatagaatgatgattactctgcgcaaactcccactggcggttgctgtcgcagcgggcgtaatgtccgctcaggcaatggctgtcgatttccacggttacgcccgttccggtattggctggacgggaagcggcggcgaacaacagtgtttccaggcaacgggtgcccaaagtaaataccgtctcggtaacgaatgtgaaacctatgcggaactgaaactgggccaggaagtgtggaaagagggcgataagagcttctatttcgacaccaacgtcgcctattcggttaaccagcagaacgactgggaatcgaccgatcccgccttccgcgaagcgaacgtgcagggtaaaaacctgattgaatggctgccgggctctaccatctgggccggtaagcgcttctatcagcgtcatgacgtacacatgatcgacttctactactgggatatttcaggtcctggcgcaggtatcgaaaatatcgatctgggcttcggtaagctttcactggcggcgacccggtctactgaagcgggcggctcttacaccttcagcagccagaatatttatgatgaagtgaaagataccgctaacgacgtctttgacgtacgtctggctggtctgcaaacgaacccggacggcgtactggagctaggcgttgattacggtcgcgccaatacgaccgatggttataagctggctgatggggcatcgaaagacggctggatgttcaccgccgaacacacgcaaagcatgttgaaaggctataacaagtttgtcgtgcaatatgccaccgatgccatgaccacgcagggtaaaggccaggcgcgcggttccgacggttcttcatctttcactgaagaattgtctgatggaaccaaaattaattacgccaataaggtcatcaataataatggcaatatgtggcgtattttggatcatggcgccatctcgcttggtgataaatgggatttgatgtacgtcggtatgtaccagaatatcgattgggataataacctgggtactgagtggtggaccgtgggtgtacgtccaatgtacaagtggacgccaatcatgagcaccctgctggaagtcggctacgacaacgtgaaatctcagcagaccggcgatcgtaacaatcaatataaaatcaccctggcgcaacagtggcaggcgggcgacagcatctggtcgcgtccggctatccgtattttcgccacctacgcgaaatgggatgagaaatggggctatatcaaagacggcgataacatttcccgttatgccgcagcgactaactccggcatttccaccaacagccgtggcgatagcgatgagtggaccttcggcgcccagatggaaatctggtggtaatacgatggtcatctgacgtaacgaggggcgcaagcccctcggaaacatcaggtctgatgatgcttgtaagccgaataaggcgccagccgccattcggcgatatgtttgggttggcgcgctattgcctggctaccgctgaacccgccttattgaggtgagaataatgaaaatgaagaaaagtctcgtcgccctctgtttaaccgcagggctgttcgccagcgtgccgggtatcagcctggcggaagtgaactatgtaccgcaaaataccagcgccgcgcccgttattcctgctgctgcgctacagcaattaacctggacgcctgtagatcagtcaaaaacgcagtctacccaactggcgactggcggccagcgccttgacgtcgccggcattaccggcccggtcgccgcttatagcgttccggcgaatatcggcgagctgacattaactctgaccagcgaggtcaataagcaagccagcgtttttgcgccaaacgtgttgattcttgaccaaaatatgacgccttcggcgttcttccccagcagttactttacttatcagcagccgggcgtcatgagcgcagaccggctggaaggcgtgatgcgcctgacgcctgcgttggggcagcagaaactctatgttctggtgtttacgaccgaaaaagatcttcagcaaaccactacgctgctcgatccggcaaaagcctatgccaaaggcgtcggtaactctatcccggatattcccgatccagttgctcgccataccactgacggcgtggtgaaactgaaggtgaaaaccaacagcagctccagcgtattggtcgggccgttgtttggctcgtccggtaccgggccggtaacggtaggcaataccgccgcgccggtcgctgcgccagcgccagtcgcgccgaagaaaagcgagccgatgttgaacgatacggaaagctactttaataaagcgattaaggatgccgtagcgaaaggcgacgtcgataaagcgctgaaactgcttgatgaggccgaacgtctgggatcgacatctgcccgttccacctttatcagcagtgtaaaaggcaaggggtaattatttccccacagtgctgattttgcagcaactggtgcgtctcctggcgcacctttttttatcatttcatgcgaattgttatttttttgttgcgcaacagatcacttaattgtgattgcgccccccgtaatgtcttttctgagatacaatgactttaggttatgaatcggagagtaaggcatgtcacaccctgcgttaacgcaactgcgtgcgctgcgctattttgatgcgattcctgcgcttgaaccccatttgctggactggctgttgctggaagattctatgactaaacgttttgagcagcagggaaagcgggtaagcgtgacgctgattcgggaagcgtttgtcggccaaagtgaggtcgaggaagcatcaggtttactgccatccgagtcccgctactggttacgtgagatactgctttgcgctgacggcgagccctggcttgccggacgtaccgtggtaccggaatccacgctgtgcggacctgaacaggtcttacaacatctgggtaaaaccccgcttggacgttatctatttacatcatcgacactgacccgcgattttattgaaattggacgcgatgcaacgctgtgggggcgccgctctcgactgcggttgagcggaaaaccgctgttgcttaccgagctttttttacctgcatcgccgctgtactgagaggaagataaagatggagtggagtctgacgcagagtaagctgctggcgtttcaccgtttgatgcgtacagataagcctattggcgcgttgctgctgctctggccgacgctttgggcgctatgggtggcgacgccgggtatgcctcagctgtggattttggcagtttttgtcgctggcgtgtggttaatgcgcgcggcgggctgcgtggtaaatgattatgccgatcgtaaatttgacggacatgtaaaacgtacggtcaaccggcctttacccagcggcgccgtgacagagaaagaagcgcgcaacctgtttgtggtgctggtgctgctggcgtttctgttggtgctgacgctgaacgccatgacgattctgctttccgtggcggcgctggcgttggcctgggtttatccctttatgaaacgctacacccacctgccgcaggtcgtgctgggggccgctttcggctggtcaatccccatggcgttcgccgcggtgagcgaatccctgccgttgagctgctggctgatgttcctcgccaatattctctgggcagtggcttacgatacgcaatatgcgatggtcgacagagatgatgatatcaagataggcattaaatcgacggcgatcttgtttggtcgttatgacacattgattatcgggattctgcagcttggcgtcatggcgttaatggcgctgatcggctggttgaatggtctgggatggggatattactgggctgtgctggtggcgggcgcgctgtttgtctaccagcaaaaactgattgcgaaccgtgagcgtgaagcctgctttaaagcctttatgaacaataactacgttggcctggtgctatttttagggctggcgatgagttactggcacttctgatgtcatgccgggcggacccggcctacaaagccaaaattttcaatacgtcatatcagttgcccgataagcttacgccatcgggcatttcaggcactggcttactcgccctgcgtcgcgctttcaatcgtcagacggacatcagaggtaatcagatcggcaagcatctgatatatcttcatcgtttctgccggttcggcatcgcccgtatcactgatataaccctcatcccgtagcgtcaacacgagtgaactgaacaccgctttgtcgaaaaactccggcgcgttaataccgtgcaggacagacagacgttgcgccacggtacggctttctttctccagcgtactgcggttgatggacggattggcgctcaacagccagaacgtaatggcataacgctgtagcgtttcgcgcgcgcctgccgccagcagttgcagcgtacgggaatgcgtcgggttgatatgcagttcatcatcctgcagggtaattagcccctgacgctgcatttcactggccagcgcgtcaatgaccgaggctaactcctcgcgctcccagcgcaggaacagctccgcttttaacatcggatagagcgcttcaacatgctgctgcaacgcatcacgcgaaatgcgacgatgctgggtgataatcgccgccatcagcgaaggcataatcaacatatgcgcgatattgttacgatagtaggtcatcaacaccgcctgctcgcgcggcagaatgatgatatcgccaatggtgtctttctcgacctcaaacttattcatctgcagcgcgtgagcgataagctcgccagcgctggcggcaggaacggttgagtctgtggaataagggacattgcgcatcagatcgagatagcaatcaagctgctcggtgagctgctcgcgggtgagcgagcgctgacgcgacgctaacagcgcggtacaacacaggttcatcgcgtttgccgcgccagcgttgttaatacgcaccatcagatcggcggcgatactatttaccgtcggcgtcagccaggctgggcgtatggcctctatagggtcgatagattcgcgccactccggcacatgctggttcaggtacgtcatgagcggcatcggttcgccaaagttaacgtagccctgacccagattgcgcagcttgctcaagcctttcagcatctgcggcaggctctctttctcttttgtcgcgccgcgcagttctttcgcataggtgcccacttccatgacgtgctcatagccgatgtaaataggcactaacgtaattggacgggtaccgccgcgcagcatcgcctggatagtcatcgacagggtgccggttttcgggtctaacaaacgtccggtacgcgaacgtcctccttcgacaaaatactcaaccgagtaaccgcggctgaacagttcgcccaggtattcgcgaaagacggtggaatagagtttattccccttaaaggtgcgacgaataaagaacgcgcccagacgacggaaaatcgggccagcgggccagaaattaaggttaataccggcggcaatgtgcggcggaaccagtccctggtgatacagcacataagaaaggagcaagtagtccatatggctgcggtgacagggtacatagacgatttcatgcccgtcgtgcgccagttggcgtacgcgctcggcgttatgcacgttaattccctggtaaagtcggttccaggtaaaccccaaaatcctgtcggtcaaacgaatcatctcgtaagagaagttcgccgcgatctcttccatcagcgcaatggcgttttgctgcgctttttcatgagagatttttttactgcgcgcttcgtcttctaccgcgcgggcgatcgctttcgaggccagcagtttgttaaacagatcctgacgggcaggcaggcgtgggccaaccgccgccaggcgctggcgagcaaagtgcatacgcgccacgcgagccagcttctgcgcgatgattttatcggtgccgtgttcatcagccatacgacgcaatgagacggacggcgagaatcggacaaagctatcgcgacccagccaggagatggcaaagaatttctgtacgccgttcagcatacgtaaaggcgggttatcttctcccttttcacgacccggcgcgcggccaaacatcacggaaacgggcaccatctgcacgtccaaagccggattactccgatgcagatcgagataatcgtgaaaaagtttcaccgactcttcttttggcgtgtaataggtaaagacacgcggtccgccgtgaataaatacatagcgtggcaacagcgcgccgtcgatctccagcggctccagcggatccgggagatcgtgcgccagacattgcgcccgcagcgtcagtaagtccgcttttgagttgtatggcaagacatacataatggggcgagaagtatcgagccccaattcctgggcgggttccgccggaatagacttgctttttaccagtatgcttaatggtaaattcagtaatttgtagtaaattcgtggccagccggacataaacgatgtaaagcctctggttaataatgcaaatgcggtgcaaggatatcagaaagtttagcgaatttctgttgtatcccgtcatacttcgcgctgcgttacggcagtccgaatcgtgcagggcaaccgtataatgtcattgacgttaataatgtaaaaaggttcttttgatggccaataataccactggattcaccagaattatcaaagcggcaggatattcctggaaaggatttcgcgccgcatggactcacgaagcggcgtttcgccaggaaagcctcgcggtattgctgggcgtcatcatcgcctgctggctggatgtggatgcgattacccgtgtgttattgataggttccgttttacttatcatgattgttgaaatcctcaacagcgctattgaagcggtcgtggaccgcatcggttctgaataccatgagctttccggccgtgcgaaagatatgggatcggctgcggtgctactgtctattttcgttgccctgatgacctggggcatcctgttatggtcacattttcgataaaggttccaaattttataaatctcttgttttttgcgccgtttgtggttccaaaatcacctttaactgtatatactcacagcatgattgtatatacacccagggggcggaatgaaagcgttaacggccaggcaacaagaggtgtttgatctcatccgggatcacatcagccagacaggtatgccaccgacgcgtgcggaaatcgcgcagcgtttggggttccgttccccaaacgcggcggaagaacaccttaaagcgctggcgcgcaaaggggtgcttgaaatcgtttccggcgcatcgcgaggtatccgtctgttacaggaagaagaggacggattaccgcttgtcgggcgtgtcgcggcgggtgaaccgcttctggcgcagcagcatattgaaggccattaccaggtcgatccttcgctgttcaaacccagcgccgatttcctgctgcgcgtgagcggtatgtcgatgaaagacatcggtattatggatggggatttgctggcggtacataaaacgcaggacgtccgtaatggccaggtggttgtcgctcgcattgatgatgaagtgacagtaaaacgcctgaaaaagcagggcaataaagtggagctgctgccggaaaacagcgagtttacaccgatagtggtggatctgcgcgaacaaagctttacgattgaagggctggcggtaggcgtcattcgcaacggggaatggttgtagtctctttttaatctccttgtaagccgccatccggcaatcgtgtagcctgatggcgctgcgcttatcaggcctacgggaatgcagttcctgagatgattaatttgtaggccggataaggcgttacgtcgccatccggcaatgcgctcgtttcgtttaactccttgtcaggcttttctccatgccgctttttacctcctctgataaagctctctggcgtcttgcgttgccgatgattttttctaacatcaccgtccccttactggggctggtcgatacggcggtgattggtcatctggacagccctgttttcctgggcggcgtggcggtgggcgcgactgccaccagctttcttttcatgctgctgctatttctacgtatgagcaccaccggcctaacggcgcaggcatttggcgccaaaaatccgcaggcgttagcccgggcgctcattcaaccgttattgctggcgctgggcgcaggcgtgatgattgtgctatttcgcacgccgcttatcgagctggctttacatattgtcggcgggaacgacgctgtcctggtgcaggcgagacgcttccttgaaattcgttggctaagcgctcccgcgtcactggcgaatctggtgctgctcggttggctgttaggcgttcagtatgcgcgggcgccggttatcttgttggtcgtgggcaatatcctcaatatcgcgctcgacctgtggctggtgatggggcttcatatgaacgtgcagggtgctgccctggcgacggtcatcgcagaatatgtcacgttactgatcggcctcatgatggtacgtaaagttctccatctccgcggtgtgtcgctggatatgctaaaacaggcctggcgcggcaacgtgcgccgccttttggcgctcaatcgcgatatcatgctgcgctcattgctccttcagctttgttttggcgcaatcacggtgtcaggcgcgcggctgggcagcgatattatcgcggtaaatgcagtcctgatgaccttactcacctttacggcctatgcgctggacggttttgcttatgcggtggaggcgcactccggtcaggcttacggcgcgcgtgacggtagcaagctactggacgtctggcgagcggcgtgtcgtcagtcaggaattgtggccttgttgttttccacagtctatgccctggcaggcgaacatattgtcgcgttactgacctcattgccgcaaatacagctactggcggatcggtatcttatctggcaggtggtattaccgctggtgggcgtatggtgctatctgctcgacggtatgtttattggcgcgacgcgcgctgccgaaatgcgcaatagcatggcagtcgccgcgggaggattcgcgctgacgctcttcgccctgccggtattaggaaatcatggtttatggctggcattaaccgtgttcctggcgcttcgcggtctgtcgttgagccttatctggcgtcgtcactggcgcgagggtacatggtttgccagatcgtgacggttaaaaattctgaatataaaaccgaaggccgaattcctgcctacaattattatcacgtccagcagaaattgcagagcatttgggcgaataacacctgctattcctaaccgaatgatgaggacaagatgatgaataaagacgaagccggcggtaactggaaacagtttaaaggtaaaatgaaagaacaatggggcaaactgaccgatgacgatatgaccgttatcgaaggtaaacgcgaccaactggtaggtaaaatccaggagcgttacggttaccagaaagatcaggcggaaaaagaggttgttgactgggaaacccgtaacaactatcgctggtaatatgttttcccctaccaggagtacatggatgtgcttccccctgtttgcttatgaatgcgggcgtgcccctctctactgccgcccgttttccgttcaggctaacgtggttttttcttcaccagcaccgagtgatcgtgaccacagtttcccggatggcgacacgcttctacttctacgcacgcagggcacagaccgtgcgcctcaataacgttatgtcgtagcgcaaagcccattttagccgccagcgtatgcatgatgtcttccacgccctcggcacactcttccttcaccacgccgcaacgatcgcagataaacatggccgagctgtgcgtcggctggtcgaacaggtggcaaaccacataactattggtggattccactttatggacaaaaccctgttcgagcaaaaaatccagcgcgcggtaaatggtgggcggtttggcctgtggttccgtttcgcgcagcaaatcgagcaaatcgtatgcgctgatggcaccctgttgcagactcatcaggcgcagcacttcgaggcgctgaggcgtcaggcgcacgttgcgctgcgcgcagagtttttcagcttgcgccagtaactcttgcgttgtggtcttttccatgtagcacctcgaatggcatgaaagtctaatccgttactttaccacgagctgcttaagactctgaaattaccccgcgacaatatatcgcctgctaagcttttccgcgccagtattctcatctatacataatgagggtcgatattataacaacaggatttaacatcactatttcacagcaatagttcgcctctgtccggtaaagcgtggtggaggaattacttcacctgataataagatgggctaactgtgaacaaaaacgtcaaactttcactgattgctatcgcggtctcgctttttatggcaaagcaggcgagcgccgccaatacctggacggaagcgcgtaatgacgcaatgggcgggacgggcgttgcgtccgcgaattatggcagcggagtactattaaatccggcgttactggcaaaagccaaaccggaagacaatatcactgttgtccttcctgcggtcggcgtccagattacggataaagacaatctccaggatgaaattgacgatatcagcgataaagtggattactacgatgaggtcgtcgataaccttacgctggggcaaattctgctcaatccgcgaggcgtgctgaatcaatttcagggcgccgcgcgcgacctggccgatgagctggaatatctcaacggaaaaaccgcccgcgccaatgccggcgccgggttggcggtaagtattccagggcaaacgctttccgtggcgtttatcgccaaaggttatgcgcatgggcgcgtgagttcgtccattgatcagaacgatattcagtatctgcgcgatatccagcatgatgaacgtgtcgcgcttcgtgaagcaggacgcgctgctttgctggggtctgacgaaattacaaagcatttaaactctaccgcgtcggggcgggtagcgattgtatctgactacggtattgcgctggcgaagcagtttgtggtgggcgaggtgcctgtttccattggcgttacgccaaaactgcaaaaaacctggctctataactacaccacctcaatttataactacgacagtagcgactggaatagcagccgttatcgcaatgacgatacgggttttaacattgatgcggggcttgctgccgatatcggtgaaaactggacgctgggggtgagcggacaaaatctggtatctcgcgatatcgatacgaaagatatttacatcactaatggtatgacgggagaaaccaccaactacaaagatacataccaaatccgccccctggttaccgcgggcatcgcatggcataacgatttgctgaccgtaagcgccgatggcgatctgacggaaacgaaaggctttaagagcgaagacaattcacagtacgttggcgtcggcgctgaagttcgaccgttgtcatggctggcggtgcgcgcagggtatcgtgcggatgtgaaaaataacgatagcaatgtggttaccggcggtcttggctttgcgccctttaaccgtgtgcatctcgatttaatgggactgtacggcgaagatgaaacctggggggcaggcgcgcagcttacaatgacattctgaggtgctttcaccggaggcgctacgcctccggtttagcgttatgctatagtaacgccccttttttaaccggatgcttatttattcgccatgcagcctgaaacccagtcctccgctttacctgcttatcgcttctccatcgcgcctatgctcgactggacggacagacattgccgctatttcctgcgtttgctgtctcgccagacgcagctctacaccgaaatggtgaccacgggcgcgattattcacggtaagggtgactatctggcttatagcgaagaagagcatccggtcgctctacagcttggtggaagcgatccggctcagcttgcgcattgtgcaaagctggcggaagcgcgtggctacgatgaaattaacctcaacgtggggtgcccttccgatcgcgtgcaaaacggtatgtttggcgcctgtttgatgggcaatgcgcaactggtcgccgattgtgttaaagccatgcgtgatgtcgtctcgattccggtgacggtaaaaacccgcattggtattgacgatcaggacagctatgcgtttctgtgtgatttcatcgatacggtttccggtcagggcgaatgcgagatgtttattatccatgcgcgcaaagcctggctttctggcttaagcccgaaagaaaatcgtgagatcccgccgctggattacccgcgcgtctatcagctaaagcgggattttccgcacctgaccatgtccattaacggcggcatcaaatcgctggaagaggcgaaggagcacctgcgccatatggatggcgtcatggttggccgcgaagcttatcagaatccgggtatactggccgcggtggatcgggagatttttggcgccgataccaccgatgccgacccggttgcggtggttcgcgcgatgtatccctatattgagcgtgaattgagccagggagcgtatctggggcatatcactcgccatatgctggggttgttccagggcatccccggcgcgcggcagtggcgtcgctatctgagcgaaaacgcccataaagctggcgcggatgttgctgtactggagcaggcgctaaaactggtggcagacaagcgttaaaagttcgccaaaaattagtcaatctcaccacgccctgtgcagtcttgcagggcgtttttcttatatatcaataatataaatattggcatgatttttgtaagggcttacctgaccagacccggtaagcgccgtgccgccgggcaatgccatttttatggggagcgactatgctggaactactttttgtgcttggcttttttctgatgttaatggtgacgggcgtctccttgctgggcattctggccgcgctggttgtagcgactgccgtcatgttcctgggcggaatgttcgccctgatgatcaagctgttaccgtggctactgctggcggtggctgtggtgtgggtgatcaaagcagtaaaaacgccaaaaatcccacagtatcagcgcaataaccgtcggttttactaaggtattgagcggttcgtcacaacctggaactttgccctcacaagcaaataggaatcgattattaaatctgtcatgattgcgcaggtaacgaattcatcgcgctgtaccctacatacagccgaacaaaaaaagaaagggcttcccgggtggaagcccaatttctttgcagagctattacggaatcagcaggcttgagccctgtgtggcccggctttccagcacttcatgcgcgcgacgggcatcttttaacgcatagcgttgattttcagccacatcgactttaatcacgccgctggcgatcaatgagaacaattcattgctggcttcggtcagttcttcacgtgtcgtaatatacccctgtagtgaaggtcgcgtggcatacagggaacctttctgattcagaatacctaaattcacgccggtgacggggccggacgcattgccgaaactgaccatcagtccccgacgttgcaggcagtccagtgaggcctcccaggtatctttccccacggagtcatagaccacgcggacttttttgccgccggtgatctcttttacccgttcgacaatgctctcctcacggtaattaattacctgccaggcaccggcgtccagcgcccgctgcgctttttgcgcgctaccgacggtaccgataagcttcgcgcccagcgcttttgcccattggcaggcgatcagaccgacgccgcccgcagcggcatgaaacaggaagggttcgtcgggtttcacttcataggttttgcgcaacaggtaaaaaacggtcaatcccttgagaaaagaggctgccgcctgttcgaaagaaatggcgtcaggcaaaatcgcggctttatctgcggtgacgttatggacggaactgtaagcgccgagcgttgactgcgcgtagacgacgcgatcgccgacgcgaatgtgctccacgccgttgccgactttactgaccacacccgcagcttcggttcccaggcccgcaggcaacgacgggggcggatagagtccgctacggatataggtgtcgatgaagttgataccaatggctttgttctcaacctggatttcgtgttccgccggttccgctggcgtaaactccacggtctgaagcacttccggaccaccatgcttgtgaaattcaatacgcgttgccatgcttcctccaaaagaaatgtggtaatctttcgacccaatcactatctcggtaactccattcactatggcaggaaataaacccttcaacaaaccacagactgatgcccgcgaccgcgatccgcaggttgccgggataaaagtgccgccgcactcgattgaagcggaacagtcggtgttgggcggtttaatgctggataacgagcgctgggacgatgtggccgagcgcgtggtggcggaagatttctatacccgcccgcatcgccatatctttacggagatggggcgcttgcaggaaagcggcagtcctatcgacctgattacgctcgcggaatcgctggagcggcagggccaactggacagcgtcggcggtttcgcctatctggcggagctgtctaaaaacacgccaagcgcggcgaatatcagtgcttatgcggacattgtgcgcgaacgcgccgtggtccgcgatatgatcgcggtggcgcatgaaattgcggacgccggttacgatccacaggggcgcaatagcgacgaactgctggatctggcggagtcgcgcgtcttccagatcgcggaaaaccgggccaacaaagacgaaggtccgaaaagcatcgaccagattctcgacgccaccgtggcgcgtattgagcagttgttccagcaaccgcacgatggcgttacaggcgtggataccggctatcaggatctcaataaaaagacggcagggttacagcgttcggatttgattatcgtcgcggcgcgtccctccatgggtaaaaccacttttgcgatgaacctctgcgaaaatgcggcgatgttgcaagataagccggtactgatctttagtctggagatgcccggcgaacagatcatgatgcgtatgctggcctcgctgtcccgcgtcgatcagacacgtattcgtaccggtcaacttgatgatgaagactgggcgcgaatctccggcacgatgggcattctgctggagaaacgcaatatgtatattgacgactcctcaggtcttacgccgacagaagtccgttcgcgcgcgcggcgtattttccgcgaacatggcgggttaagtctgattatgatcgactacctgcaattgatgcgtgtgccgtcgctttctgataaccgtactctggaaatcgccgaaatttctcgctcgttgaaagcgctggcgaaggaactccaggtgccggtcgtggcgctatcgcagcttaaccgctccctggaacaacgcgcggataaacgtccggtgaactccgacctgcgtgaatccggctctattgaacaggatgccgacttaattatgtttatctaccgtgatgaggtttatcacgagaacagcgacttaaaaggcattgctgaaattattattggtaagcaacgtaacggtcctatcggtacggttcgtctgacgttcaatggtcagtggtcgcgcttcgataactatgcgggaccgcaatacgatgatgagtaactctccgtcattcttttaacaaggaattcaaatgcaagcggcaacagtcgtcattaaccgccgcgctctgcgacacaacctgcaacgtctgcgtgaactggcgcctgccagtaagctggttgcggtggtgaaagcgaacgcttatggacacggtcttctggagaccgcgcgaacgctccctgatgctgacgcttttggcgtggcgcgtcttgaagaggctctacgtctgcgagcgggcgggatcacgcagccaatcctgctgctggagggttttttcgacgccgccgatttgccgaccatttccgcgcaatgtctgcataccgccgtacataatcaagagcagcttgccgccctggaggcggtggagctggcggagccggtaacggtctggatgaagctggataccggtatgcatcgtctcggcgtgcgtcccgaagaggcggaggcgttctaccagcgtctgacgcactgtaaaaatgtacgccagccggtgaatatcgtcagccattttgcccgtgcggatgagccggaatgcggcgctaccgaacatcagctcgacatttttaatgccttctgtcagggtaaacccggtcagcgctctattgccgcgtctggcggtatcctgctgtggccgcagtctcactttgactgggcgcgtccgggcatcattttgtatggcgtatcgccgctggagcacaaaccctgggggccggattttggttttcagccggtgatgtccttaacctccagtttgatcgcggtgcgtgaccacaaagcgggcgaaccggtgggctacggcgggacatgggtgagtgagcgcgacacgcgcctgggcgtggtggcgatgggttatggcgatggctacccacgagcggcgccttccggtacgccagtactggtcaatggtcgtgaagttccgattgtcgggcgggtggcgatggatatgatttgcgtagatttggggccaaacgcgcaggataacgcgggcgatccggtggtcttatggggtgaaggtctgccggttgaacgtatcgctgaaatgacaaaagtaagtgcttacgaacttatcacgcgcctgacctcaagggtggcgatgaagtatattgattaaatacgcggcgggccgggtggcgcttgcgcttatccggcttgtatcgcgcattggctgtaggccggataagacgttcacgccgtcatccggtaatatgcgcatccaccacaacatcctctcgatcttctcgtccttccggtttattgtgttatttcctgccctctgtaaacctggagaaccatcgcgtgtttcaaaaagttgacgcctatgccggcgatccgattctttcactgatggagcgttttaaagacgactcccgtcacgacaaagtgaatctgagcattggcctgtattacaacgaagacgggattatcccacagcttaaaacggtggccgaagccgaagcccggcttaacgcgcagccgcatggcgcttcgctgtacctgccgatggaaggactcaatacttatcgccatactatcgcgcctttgctctttggcgccgatcacccggttcttcagcaacagcgcgtggccactatccagacattaggcggctccggcgcgctgaaagtaggcgcggatttcctgaagcgttatttccccgacgcaggcgtatgggtgagcgaccccacctgggaaaaccatattgcgatatttgccggggcaggattcgaagtgagtacttacccctggtatgacgacgcgactaacggcatccgttttaacgatctgctggccacgctgaatacgttacctgcgcgcagtatcgtgttgctgcacccctgttgtcacaacccgaccggggcggatttaacgccttcgcaatgggatgcggtgattgaaatagtgaaagcgcgcgatctgattccgtttcttgatattgcctatcaggggtttggcgcaggcatggacgatgatgcgtacgttattcgcgccattgccagcgctgggttacctgcgttagtcagtaattctttttcgaagattttctcgctgtacggcgagcgcgtcggcggcctgtccgtggtgtgtgaagatgctgaaatcgccgcgcgggttctgggacagctaaaagcgacggtgcgccgaatttactccagtccgccgtgtttcggcgctcaggtggtcgctacggtcctgggcgatgaggcgttaaaagcgggctggctggcggaagtcgacgcgatgcgtaaccgcattatatcgatgcgccagacgctggtgaaggagctgaaggcggagatgcctgaccgcaactttgattacttgttacagcagcgcggtatgttcagctataccgggttaagcgaggagcaggtcgatcggttgcgcgatgagtttggcgtttacctgattgccagtggccgcatgtgtgtcgccgggcttaatgcttcaaatgtacaccgcgtggcgaaggcatttgccgctgtcatgtaatattcaggccggacggcgataacagtgccctccggcctgacaatagctgttgtgatcatcctcttttttcgtaacaaaaccgcagataatccttccttttgaccgttactggcgttatggtcagatagttttttgagcaaagactcatcttaataattataatattttgaattttaagggaaaaccatgaaaaaaataaccctggcgctgagtgccgtctgtttgttgtttacgctaaaccattccgcgaatgcgttagtatcttccccttcgacgctcaatccgggcactaatgttgcaaaactcgcggaacaagcgcctgtccattgggtctctgtcgcccagattgaaaacagcctcaccggacgcccgccgatggcggtcggctttgatattgacgacaccgtgttattttccagccccggattctggcgcggaaagaaaacctactccccggacagcgacgattatctgaaaaatccggccttttgggaaaaaatgaacaacggctgggatgagttcagtattccaaaagaagtggcccgacagctcattgatatgcatgttcgccgtggcgacagtatttactttgtcactggtcgtagtcagacgaaaacggaaaccgtgtcgaaaacgctggcggataacttccatattccggcggcgaatatgaatccggtgattttcgccggcgataaaccggaacaaaatacgaaagtacagtggctgcaggagaagaacatgcgtatcttctacggcgattcggataacgatattaccgcggcccgtgattgtggtatccgcggtattcgcatcctgcgcgcggctaactccacctacaaaccgctgccgcaggcaggagcgtttggcgaggaagtcattgtcaactcggagtactaaaaatcaggagagcgacaggctctccttttttgcatgatttttgcacaaacttgccccgctggcttttaccttttccagacttgctgcacactattcaggagacgtttgtttttaggaaggagcagcctatgtggtatcagcgcaccattacactgagcgagaagccgcgcgggtttcatctgataacagatgaaattaccgataaattgtctggcttaccgcctgtcgaaacgggtttgctgcatctgttgttgctacatacctcggcctcgctgacgttaaacgaaaactgcgatcccaccgtgcgcgctgatatggagcgccatttcctgaaaaccgttcccgataatgcggcgtatgaacatgattacgaaggcgcggatgacatgccttcgcatattaagtcgtcagtattgggcgtctcgttgctgctgcctgtacgccaggggcgtttacagttaggaacatggcaaggtatctggttgggagagcaccgtattcacggcggtccacgtaaaatcatcgcgacactacaaggggaatgataatgaccatttcggaattactgcaatactgcatggcaaaacctggcgcagagcagagcgtccacagcgactggaaagcgacgcaaattaaagtggaagatgtacttttcgcgatggtaaaagaagttgaaggacgcccggcagcctctctcaaaaccagcccggaactggcagagttgttacgtcagcagcacagcgatgtacgaccgagtcggcaccttaataaagcgcactggagcacggtctatctggacggctcgctgccggattcacaactctattatctggtcgatgcctcttatcaacaggcggtaaatgcgctgtcggaagataaacgcaagcagttgccgcagtcctgattatagcgcgccgaccaacaacgccagggcgatatcaatgaggcggatgaccgtagaccggatacggctgccgagggcgatttgcgcattattggcgcgtagcctggcgaggtcccgctgtccttccagcagaataatcatatcgtcgtcgtccagccagccgcgagcatgttcctgaagcgcgcgggcgataaacgcggcggactcgcggatagcgtcgtcgctgtcttctcttgcctgcttatacgtctggataaactcggcaatcgccgaggacgctacagggtgttcggcctgggcggtggttatcaggtaatgtatttcgttaatagacgccattttcatctccctgagtgcagcgggcgccccaatgcagacactcgccctgtatggctaatttccagacctgattattttgctgttggtatctctcagcctggatgtaagtaagtggttgcttacgtcgcataacccgcgcataaagacgcaaatagtgatttttcagcagcgccagattatcgagacggtgtttatccccaccttgacgggcgacccgctcagcctgaaaaaatatctggcggatatcgcggtcatccttgagcagtgtctctttttgccacggtattcgcgccgcgtcctgcaggaagcgggttgagcgcgcttgtaatagcgttagttgttgaaaagccacggcgctaaagcggtcaggcagcgtacaggcggataaaaacaggcacagcagtagtgtgattgcgtagggcaacttcatggtgttttccataacagaccgtttgcgctatcacatgtcagagcgaggcggcacgcaaatcacaaatgctcaacacggatacaatgaggtgggatgaggaaaaatgatgccgcttcccggcgaatcggaaagcggcgtgaaggttatttgagcataggtttaaggaagcgggcggtatgcgacgcctcgcactccgccacggtttccggcgtaccggcgacgagaatttcgccgccgccgctgccgccttccgggccgaggtcgacaatccagtccgccgttttaatgacgtccaggttgtgttcgatcaccacgatggtgttgccctgatcgcgcaactgatgcagaacgtcaagcaactgctgaatatcggcaaagtgcaggccggtggttggctcgtcgagaatatacagcgtctgcccggtgccgcgcttcgacagttcgcgcgccagcttcacgcgctgggcctcgccgccggaaagcgttgtcgccgactgaccaagacggatataggtcagccctacgtccatcagcgtctgcagcttacgcgccagcgccggaaccgcatcaaagaactcacgcgcttcttcaatggtcatatccagcacttcgtggatggtcttgcctttgtacttaatctccagcgtttcccggttatagcgcttgcctttgcactggtcgcacggcacgtaaatatccggcagaaagtgcatttcgactttaatgacgccatcgccctggcacgcttcgcagcgaccgccgcgcacgttgaagctgaatcgccctggcgtgtagccgcgcgagcgagactccggcacgccagcaaaaagctcgcgaaccggggtaaagacgcccgtataggtcgccgggttggaacgcggggtgcgcccgattgggctctggtcgatatcgatcactttatcgaaatgttccagcccctgaatatcccgatacggcgccggttcggcgatagtcgccccgtttaactgacgctgggcgatggggaacagcgtgtcgttaatcagcgtcgatttaccggaacccgagacgccggtgatacaggtaaacagccctaccggtagcgtaagggtcacatctttcaggttgttgccgcgcgcgccggtgagtttgagcactttttctggatttgccggcacgcgttgtttcggcacttcaattttgcgtttaccgctcatgtactggccggtcagcgattccggtaccgccataatggcttccagcgggccttccgccaccacctcgccgccgtgaacgcccgcgccggggccaatatcaatcacatggtcggcggcgcgaatggcgtcttcatcgtgttccaccacaatcacggtattgccaagattgcgcagatgaatcagcgtacccagcagccgttcgttatcgcgctggtgcagaccgatggacggctcatccagcacatacatcacgccgactaacccggcgcctatctggctcgccagacgaatacgctgggcttcgccgccggaaagcgtctctgccgagcgggagagcgtgagatagttcaggccgacgttcaccagaaacttgaggcgatcgccgatctcttttagcactttttcggcgattttcgctcgttgcccggaaagcttgagattagtgaaaaaatccatcgcatggccaatgctcatatcagaaatagcaggcagcggcgtattttccacaaatacatggcgcgcttcgcgattcagtcgcgtgccttcacagctggcgcaggggcgattactgatgaacttcgccagctcttcgcgcaccgcgctggattccgtctctttataacggcgctccatattatgcagcacgccttcgaacggatggcggcgcacggaggtatcgccgcgatcgttcatatatttaaattcaatgttctctttgccggaaccgtacagcacgactttatgtacgttggcgctgaggcttgcccacggcgcatctacgtcgaacttatagtgttccgccagcgacttgagcatttgaaagtagtaaaaattgcgacgatcccaaccacgaatcgcgccgcctgccagcgacaggtcgggattctggatcacgcggtccggatcgaaatattgctgaacgccgaggccgtcacaggtcgggcaggcgcctgccgggttgttgaacgagaacagacgcggttccagctcgcgcatactgtagccgcaaatcggacaggcaaaattggcggagaacagaagctcctccgctttctcatcgtccatatcggcaacaaccgccgtgccgccggataattccagcgccgtttcgaacgactccgccaggcgttgggaaagatcgttgcgaactttgaagcgatcgatcaccacctcaatggtatgtttcttttgtagctccagcttcggcggatcggagagatcgcagacttcgccgtcaatacgggcgcgaatgtaaccctggcttgccagattttccagcgttttggtgtgttcgcctttacgctctttaataatcggcgcgagcagcatcagacgtttgccttccggctgtgacagcacgttatcgaccatctggctaacggtttgcgccgccagcggcacgtcatgatccggacaacgcggctcgcccacgcgggcaaacagcaggcgcaggtagtcgtggatctcggtaatagtacccaccgtagagcgcgggttgtgcgatgtcgatttctgttcaattgagatcgcgggcgatagcccctcaatatggtcgacatccggtttttccatgagcgacaaaaactgccgcgcgtaagcggagagcgattcaacgtaacgacgctgcccttcggcatacagagtgtcgaaagccagtgaggatttgcctgaacccgaaagcccggtcacgacaatcagtttgtcgcgggggatgacgaggttaatatttttgagattatgggtgcgggcgccccgaacttcgatcttatccattcacctttcccggtagagactcggatgcctggtttgtttgaaggacaaacggcagaaacggctaattatgacacaatttaacctgtttgaatatacagtattggaatgcatcttcagctaaagtatgcaacaatatgaggttcgcgcgagtgacctggaacctgcatcgcagctattaaaatgctacgtggaaatggtacactcacgcgtttacactatttatgaaacgtattcaggagactcaattatggccagcagaggcgtaaacaaggtgattctcgttggtaatctgggccaggacccggaagtacgctatatgccgagtggcggcgctgtcgccaacttaacgctggctacttctgaatcctggcgcgataagcagaccggcgaaatgaaagagcagactgaatggcaccgggtggtgatgttcggcaaactggcggaagtggccggcgaatatctgcgtaaaggttctcaggtgtatatcgaaggtcaattgcgtacccgcaagtggaccgatcagagtggccaggaacgctatacgactgaaattaacgttccgcagatcggcggcgtgatgcagatgctgggtggtcgccagggcggcggcgcaccggcaggcggtcagcagcaggggggttggggtcagccgcaacaacctcagcagccgcagggcggcaaccagttcagcggcggcgcgcagtcgcgtccacagcaatccgcgccagcgccgtctaacgaaccgccaatggattttgacgacgacattccgttctgatttttggtaaaaaactcaaagcgttatttgcattttcgctatagttctcgtctgctgaaatgcctggtgtaaaccaggcattttcttacctggtattattgtctttgtatccctttcaaaaaagagaagcgcatatcttacggaaaaatgtcgcttatcgcctctggccgactcgcctcggcacatcattatccagccgaagttcataaatgtactgcaataacccggattgtcttaaatatgaaagagaaatctcatctgcaaaatatataatttatagccattttttgacaacaaaaagatattataaaataacggtagagaatggtcggtattatcaatggttaattaaatgtttgctttagcttgtgatgagctcaaatatgatatgtgtatcttgctttatttttaattgctgaagataaaattgttacttatagctggctttatataaaaaatggttttatttgtgtatttttttacacaattctgattttttactccccacttattatattttcaatgatttaagttatattgaagtccatatgaccctatgttttaattgtgaaaattaattttatcctctggaggcaaatttattaaatacgtatggttataacgcgtattaaaaagaaatatgtccttaaaatgatttagagtttcaatgattagctaacaaatctatttatcggcgggtggttttaatttgctgatgactattttttatttatgagttgagagcttatgcgatacctattattggggaggatatagttagtgcaataattgatgtctacctaattaaaaaaatgaagagtgtttttaattaaagcactcatctttgttgtgggcgcataaaaatggcgtcgttgtttttatttttctgattacgagatgtaagaaaactgaaatctataaagcgtattggtagcaggaagccaagggcggtagcgttcactttctgaataagttgagcatcctttatcctttctaatccacaaaaacattttattcacaatgtaatatcaggagacaacatggaagacgaaagtaatccgtggcctagttttgttgatacattctctacggtattgtgcatttttatatttcttatgttggtgtttgcacttaataatatgattattatgtatgacaactcaattaaagtttataaagcaaatatagagaataagactaaatctactgctcaaaatagcggagccaatgacgattcaaatcctaatgaaatagttaataaggaagtgaatactcaagatgtgtcggacggaatgactacaatgtcaggtaaggaggttggagtatacgatatcgccgatggtcagaaaactgatataacgtctacaaaaaatgagcttgttattacgtatcatggcaggctgagaagcttttcagaagaggacacttataaaataaaggcttggttagaagacaaaatcaatagtaatttattgatagaaatggttattcctcaggcagacatctctttctctgactctctacgactgggatatgaacggggaattattttgatgaaagagattaagaaaatatatcctgatgtagttattgacatgagtgttaactccgcagcatcaagtacaacgagtaaagctattatcacgactattaataaaaaggtgtcagagtgaaatatataaatcattaccgctatttgtttgtctgttttttccttgccatactccctttttttgctttatcttttcccggtataagagagtatgtttttgataacttcatggtttctgcaatttacaatggagtcattattgccatttatattacaggttctttgtgtgcattattcactattcttaaaaatatttcagcaaaagacatattaatagctcaggacgccagtagaaaaaatagcattctttctaacctcaatcaggttttgtttgccggggagtccaaacagtgtgatttcaatttactgatggaattagatgacaatgtgtctaccgcccgtaatcaacgattgtcatttattatgagctgtagcaatgtgtcgacgcttgttggcctgttggggacgtttgcgggtctgtctattacgattggttcaatcgggaacttattgagctcgccatcagatgttggcggtgataatgcaagtaatacactcaatatgatcgtgacaatggtagcgtcgctttctgaaccattgaaagggatgaataccgcatttgtatcttctatctatggtgttgtttgcgccatactcctgacctcacaaagtgtttttgttcgcagctcctattcccttgtttctacggaaatcaaaaaattaaaaatcataagcaacagagccaataataaacagcgaagcctgcgggttgaatcagagacgcttgtagaatttaaagagttgtttaaagcgttttttgataactacctgacagttgaaaacttacggacgcaggatgaagaaaagaaacgagagatgctatcagatagctttgtcactttgcaaaaccgactattggataactcagcaaaactggaacaaatttctacgctgattgatggttatctggtaagcagtaacgaaaatctcaaaaaattatctgacggtgtaataacaattacctctcgtttatctgaaggtaatatcctgcttgctgataataatgcacgactggaggcaatgagtacaatacaaaatattatagataaaaagaatgattcaataatgacatcagttgataaatgttatcaggaatctctttcacatggtaagaccataaacgatattgccgctggcagtgccgatatttctcatactctcgatgggctgagaaaagaaatggatgaggatatgaataatgttcatttagcgctatccgatctatcggctactgataaaaagattattgccaatactaaagagattagtgctgaaatggttagctaccgtgatacctatatgccattaatggaaaaaataacatctatgcatcaggaaatagtaaagcaacgtttgttaaacaaggaggaaaaaaatgaagattaagatgttttttctgacgactgcttttattacacaaagcacatacgccagcgagcttccggtcattcctctaagagatttagttaatgccgcattaacgcatcagccctctgttgctgtttcatattatgagactgaaaagaaaaacagtgacttagatctttcacgggcagcactttatcctaccctggatctaacatctggccttaataataacaggaaagagtcatcaggtaccgagaggaacgttgaaaataaggtgtctttatcataccgaataacggattttggagtgaggggggctaatatcaggaaatctgaatatgaaagagataatagtaaaactgactatgaaaaaacaaagaatatagtgtctcaggaggttgtgacaacctattacaacatcagtaaatatcgtgaaatgattgatggcgtaaatctggagaaagagttttataaaaagatgctggaaactttttcgttgctggtatcttccggtgtagctatgcaatctgatatgcgtaaagtacaagtatctatcgatgcattaaataccagaagcattatgtatcagtcgatgttggatgatgaaatgtataaaatgcagaatatgactggtctgaatttatcgccagttcagattcaaagcgatgaaaaattcaacctcttcaaaaaatatatctttgtcgaaagccctgaaaaacttatggacatggtgatgaaatacaacgatgactataagatgcttgtcaatacccgaaaagccgcgaccgaagatattaatgccgcaaaatcatcctattttccgactgtagatcttgtttccagctatgtacagaataacccgagcggtagtgccaaaaaaagtgattatgaagatgaatttaaaacgggtatcaatgtcagtttcaacatttttaatgggttcagaaattcagcccaggaaagaaaaatggtggcaagttactcgcaggctaagctgcaaattgacgattttttgattaaaacgcgttataacattgattcacaactttcaagatacgccgctgcaaaagagacttactcagtggcggaacgttcacatacaaacgcgttacagcttactgaattatatgagcaggagtttcagttagggcaaaaaagtttgcttgatttaatttcaagccgtaatgaagcatttcaggcatatgtaagcatgatcgacagcaaatatagcctgtatattttaaagctacagcaactctcattgatttttcatttaatggattatttaaaaggaaatactgaaagtgagttaaatgtaatgaaatgaatagaagacaaagcgatcatctcatgatgataattatttctttgacgatcttaattattatccttacctactttatagaaattaattcagtggttcatggtcagggcgttatcactactaaagataatgctcagttaatatctctttctaaaggagggacgatacaagatatttatgtagccgagggtgatactgtaaaaaaaggagaactccttgcaaaggtcgttaaccttgatctgcaaaaagaatatcaaaggtatagaactcaaaaagggtatctggataaagatgttaacgaaatatctttcattcttgataaagaaaatgagagtgggttgattaccctggatggcacccgttctttaagcaataaagaggtaaaagcgaatattgaattagtgcatagtcagataagagctaaagagttaaaaaaaacctctcttgattctgagattagcggattacaagagaagctgagttcgaaagaaaaagaactcgcattgcttgccgaagaaataaatattctttccccactggtaaaaaaaggaattagcccatataccaattttcttaacaagaaacaggcgtatataaaagttaagtctgaaattaatgatattgaaagtagcatcactttaaaaaaagatgatattgagttggttgttaatgatattgaggcgcttaataatgaattgcgactatctttatctaaaataatatctaaaaatcttcaggaacttgaggttgttaactctacattaaaagtaatagagaagcagataaatgaggaggatatctattcaccggttgacggtgtaatttataaaatcaataaaagtgccactactcatggtggtgtgattcaggcggcggacttactttttgaaataaaaccaaaagtaaggactatgctggccgatgtgaaaatattacccaaataccgtgaccaaatatatgtagatgaagccgttaaactggatgtgcagtcaattatccaaccaaagataaaatcgtataatgcgactatcgataatattagccctgattcctatgaggaaaataccggaggaacaattcagcgttattataaagtaattattgcattcgatgttaatgaagatgatttacggtggttaaaaccaggtatgactgttgacgccagtgtaattaccggaaaacacagcattatggaatacctgttatctcccttgatgaaaggcgtggacaaagccttttcagaaccagttaatactaaacgattagatacaccttgagagtgaatataatattatgggaaataaaagcatacaaaagttttttgccgatcaaaattctgtaattgatttatcttctttgggtaatgccaaaggcgcaaaagtttctctttccgggccagacatgaacattaccacgccgcgtggttcagtgatcattgtcaatggcgctctttattcaagtatcaaaggcaataacctcgctgttaaatttaaagataagactattaccggcgctaaaattctgggcagcgtagatttaaaagatattcaactggagagaattgacagctcattggttgattctgctcaggtagaaaagaaaggtaatggcaaacgacgaaataagaaggaagaagaggaattaaaaaagcagcttgacgatgctgaaaacgcaaagaaagaagctgataaggcgaaggaagaagcagagaaagctaaggaggctgcagaaaaagcgctcaatgaagcgtttgaagtacagaactcgtcaaagcaaattgaagaaatgctgcagaactttttggctgacaatgtagcaaaagacaatctggctcagcaaagcgatgcttcccagcaaaatacacaggctaaagcaacgcaggcttctaaacagaacgatgctgaaaaagttcttcctcaacctattaataaaaataccagtactggcaaaagtaatagcagtaaaaatgaggaaaataagctcgatgccgagtctgttaaagagccgcttaaagtcacattagcgcttgcggccgagagtaacagcggtagcaaagatgatagtataactaattttaccaaacctcagtttgtaggtagcactgctcccaatgccacggttattattaaaattaatggtattgctgtcggtcaggctgtagcggatagtttgggtaacttcacctttacagcgcctgaaacattgactgatggaacatataatctggaggcagaggccaagactgctgatgggagcggtagcgccaaacttgtcattactatcgattccgttaccgataaaccaacatttgaactttcgcctgaaagtagtgtgtccggtcataagggcttaacgccgaccttgacgccttcaattgttggtacggcggaagagaatgctaaggttgacatttatgtagataataaactggttgccagcgttgatgtcgataaagatggaaactggagttatgaatttaaggataatgaattatctgagggcgaaaatagtataaaagtcgttgctgtagataaagcaggtaataaaaacgaaacgacggatagtatcataaccgacaccattgctccagaaaagccgacgattgagctggatgatagtagtgattccggcattaaaaatgacaacattacaaatagcaccctgccaacatttattggtgtggcggaacccggttctacagtctctatttatcttggacttaaacatcttggtgaggtcattgttgctaaagatgggacatggagctatacgcttactacgccgctcaaggatggcgaatacaatataacagcaacagctactgatattgccgggcatacctcagcgacggcaaatctgccttttactattgatacacgtatcagctatttcagcgctgagattgaaacgacgaatgatagcggtattgtcggagataacgttactaacaatactcgcccaacctttacaggtaaaactgagccaaatgctattatcagtgtcataaatagtgagactggcgaagaggttatttttaaagcgaatgacaagggcgaatggacgttcaatttcacttccgactcagtggaagggattaacaatcttacgttcactgttgaagatgtcgctggcaacaaaaaggatttttcctttagttacgttattgatactattgcccctgtacctccgacggtttctttggaggattatgttgttttgccgaatggtataattttatcagggaatgatttaccggctttagtcggtacggcagagccaaagtctaccatcttattgatgcgagatggtaaattatatgacagcattgaggttgactcaaacgggacctggaattatcagtttagtaataaatttcttcagggcgcctatgatattgaaatcatttctcaggatgccgccggcaataaatcctctactgttaaatattcttttactattcaaactgaagttgtacctccaaaagcggaactcgatgccagtgatgattccggtgcaaaaggcgactggattaccaataaacataatgctctgacattactgggaacagcggataggtttgctaccgtaaatatccttattgacggtaaaacgataggcgtgacgactgcggatgcagacggtaactggaattttgatatttccagaaatctgtctgacaatgtttataagattacggttgaatccatcgatcctttaggaagaacgtcatctgtagattatcagcttaccattgatagctttacgccgatccctactgttatgttgcatgatagcgctgactctggcgttaaaggcgatatgattactaaaattaatacaccgttgtttaccgggatggctgaagctaatgctaaggtttccatctatgttgacggtgtgttaagtggtgaggctattgctggcgatgatggtgtatggaattttcaatttaccacagcgttatccgatggctcgcatgacgtaacggtaaaggtagaagatattgccggtaatactgcctcctcatcagcgtataatttccaaatcgtaacgcaaacgcaaaaaccaacaatagagttggtcaacgatacgggggttgataatacagaccatattattaatgaaaagaatcctgcactgacaggaaccgctgcaccctattcaacggttaaactctatattgatggtgcactgatcgctgaggtcagaacaaataaagatggcagatgggagtataccctgaaagccgatcaaggtttggttgatggcgatcatagaataaccgcttcagttgaagatatcgctggcaacattgctcattcggatcctttcttaattagcgtcgatactgctatttcaataccgatagtttcattgagcccggattcagattcgggaatttcagatgataatttaacgaatatcgttaaacctaccttgcacctaaaagatattgatccggacattatcagtgttcaggtatgggatgccatgtctgatacgcagatcggtgttgccacgcaacaacctgatggttcatgggcctatacctttacttcagatttaacggaaggcttgcatcaggtttatgtcaaggttgaggacattgcgggtaataaagcgaacagcgcgatattcgattttactatcgataccacagtatcaacgccggtgatttccctgctttctaaggatgatacgggggttacaggcgataacctgaccaatatcaataagccaggttttgctatttccggtgttgatgccgatgcgcatcgggtcgtcgtacaggtgatgcacaatggcgtgagcgaagagatcgaactttcccacctcaatggtagttggttatttataccagggaatacgtgggcggatggcagctacacgttaacggtgaaagtagaagataaggcaggaaataccaactactcagcgccgctgacggtcgttatcgatacccaaatcgccattgatggggtggaactggtcaacgatagcggcgtgaaaggcgataatatgaccaacgacgaccgtccccactttcgtgtgacggtacctacggatgtcaatgaagtccgtctgagcattgacggtggtaattcgtgggttcaggcaactccgggcgtggcaggaagctgggagtatatctggccgacagacctggcagatggtcaatacacgctaacggtggaagcgactgataaagcaggcaatacagtgacgaagaccatcgatttcgcggtggataccacgctgtcagtgccggtcatcgtactggatagcgcggacgacaccggcatccagggcgataacatgacgaatagcacccagccgacatttgccctgcagcatattgatgatgatgccgttcgcgttacggtcagcgtggagcatggcggcgtcaccaccacatttgacgccacgaaaggcacaggcggatggacctttacgccgccgacatcatgggcggatggtgattataccctgagtgtgtcagtcgaagataaagcggggaacaccagccattctgcatcgctgacggtgacggtggacacgcaaatcgccattaataacattgaactggtcaatgacagcggtattcccgacgataatctgactaataatgtgcgtccgcacttccaggtgacggtaccgacggatgtcaacgtggtgcgcctgagcattgacggcggcaagacgtggttcaacgctacccagagcgcgacgccaggcgtctgggattatatctggccggatgatgtggccgacggaggctataccctgacggtagaagcgaccgatgaggcgggaaataaggcaacacagacgctcgatttcaccatcgataccactctgtctgtgccgaccctctcgctggacagcgcagatgacagcggcatcgcgggcgataatatcaccaatgttaaaacgccgggctttaccctcaacaatattgataccgatgtcagccgggtgatagtggaggtaatgcacaatggcattaaacaggaggtgccactggttcagaccggcggacagtggcgctttgcgccgaccagcgactgggcggacggcgactatatcctgacggtgaaggtagaagatagggccggaaatgtgaagcagtccgcgccgttgacggtgacagtagacacgcatatcgccattgaccgtattgaactggttaacgacagcggtatccccggcgataatctgaccaatgaagcgcgcccgcactttcaggtgacagtaccggcggatgttaacggtgtaagactgagtattgatggcggcaaaacgtggtttgacgccacgcagagcgcgacgtcgggcgtctgggattacacctggctgacgaatgtggctaacggccctcacaccctgatggtggaagcgtccgacaaggcgggaaacaaaacgacgcagaaactggacttcaccatcgataccattctgtcagaaccgacgattaccctggacagcgcggatgatagcgccgctggcgataacatcaccaacgttaagatgccaggctttaccctcggtaatatcgacgccgacgtgaccaaagtggtggtgacggtggcgcatgatggtaagaaccaacagatagagttgattaagaacggcggtgtgtggcgctttacgccgggcgcagcctggaccgatggcgactatacgttgacggtaaaggtagaagataaggcgggtaatacaaattattctgcgccgctgacggtgactatcgatacgcaaacgtctattgatcgcattgagcttcttaatgacacgggtattgtcggggataacctgaccaatgaagcacgtccacagtttcatattacggtaccgacggacgtgaactctgtgcaactgagtcttgatggcggcatcaactgggttaacgcaacgctgacgtctgacggcgtttgggagtatatatggccgacagatctggtcgaaaatacgtataccctgacagtgaaagcaaccgatgttgcaggcaacacggcgacggaaacgctcaattttatcattgataccacattgtcgacaccgaccatcacgctggatagcgcagatgatagcggcaccgccaacgataataagactaacgttaaaacgccgggttttattatcggcggtattgattctgacgtgactcaggtcgtcgtgcaggtgatgcgcgatggtcacagcgaggaggtggagctgacgcagactaacgggcagtggcgttttgtacccggcagcgcgtggactgatggcgactatacgctgacggtaacggtgaaagatgaggcgggtaatattcgccactcagcgccgttgacggtcaccatcgatacgcaaatcaccattgaccatattgaactggtcaatgacagcggtattcccgacgataatctgactaataatgtgcgtccgcacttccaggtgacggtaccgacggatgtcaacgtggtgcgcctgagcattgacggcggtaagacgtggttcaacgctacccagagcgcgacgccgggcgtctgggattatacctggctggctgatgtgggagagggtaagcataccctgacagtggaggcgaccgacaaggcgggaaacaaaacgacgcagcaactggacttcatcatcgataccctactgtcagaaccgactatcgtgctggacagcacggacgacagcggaacaaaaggcgatcacctgaccaacgtaaataagccgacgtttttactgggcaatattgacgcagacgcgcggtatgtcacggttgaggtacagcatggcggcacgaaagaggtgctgacggccaccaaagacgcgaccggcaactggagcgtgacaccgaccggcacatgggcagatggcgactatacgctgacagtgagggtggaagatgaggcggggaacgaaaaacactcagcgtcgctgacggtcactgttgatacccaaatcaccattgatgttattgaactggttaatgataacggtattcccggcgacaatatgactaacgacgcccatccgcagttccgcgtgacggtaccgggggacgttaacgaagtcagtctgagcattgacggtggcgtgacctgggttaaggcgacacagagcgcgacgccgggcgtctggaattatacctggccgggcaccgtgccggatggcgactatacgctgaatgtgaaagcgactgacaatgcgggtaatacggtgacggagacactccacttcactattgatactacgttgtcgacgccggtgatcgtactggatagcgcggacgacagtggtgtccatggcgataacatgaccaatcacacccagccgacatttgccctgcagcatattgatgatgatgccgttcgcgttacggtcagcgtagagcatggcggcgtcaccaccacatttgacgccacgaaagacgcaggcggatggacctttacgccgacaggggcgtgggcggatggtgattataccctgagtgtgtcagtcgaagataaagcggggaacaccagccattctgcatcgctgacggtgacggtggacacgcaaatcgccattaataacattgaactggtcaatgacagcggtattcccgacgataatctgactaataacgtgcgtccgcacttccaggtgacggtaccgactgatgtcaacgtggtgcgcctgagcattgacggcggcaagacgtggttcaacgcgacccagagcgcgacgccgggtgtctgggattatacctggctggctgatgtgggagaggggaagcataccctgacagtggaggcgaccgacaaggcgggaaacaaaacgacgcagcaactggacttcatcatcgataccctactgtcagaaccgactatcgtgctggacaacacggacgacagcggaacaaaaggcgataacctgaccaacgtaaataagccgacgtttttactgggcaatattgacgcagacgcgcggtatgtcacggttgaggtgcaacatggcggcacgaaagaagtgctgacggccaccaaaggcgcgaccggcatctggagcgtgacaccgaccggcacatgggcagatggcgactatacgctgacggtgagggtggaggatgatgcggggaacgtaaaatactcagcgccgctgacggtcacggttgacacccaaatcaccatcgatgttattgaactggttaatgataacggtattcccggcgacaacctgaccaatgacgttcgtccacacttccgcgtcacggtgccaggggatgtcaacgaggtacgtctgagtatcgacggcggtaatacgtgggttcgtgcaacacagggcacggcagggatctgggattacacctggccgaaagatgtgaccgacgggctacataccctgacggtagaagcgaccgataaggcgggaaataagacgacgcagacgctcgattttaccattgatacccggctgtcaacgcctaccatcgctatggatagcagggacgatacaggtgccattggcgatcatattacgagcgtcaaaagaccgggctttactattggcaatattgacgccgatgcgcactcggtcattttgcggatcacacagggcggcaatagccaggaagtgacactaacccaggttggaggacagtggcgctttacgccagatgctgactgggcggacggtagctatacgctgacggtagaggtaacggataacgcaggaaacgttcgtcagtccacgccgctggtggtgacggtggacacgcaaaccagcattactgatattacattggtcaatgatcatggcgtgcctgatgacaatctaactaatagcacccgtccgcagtttgagatcacggtgccggcggatgtgaattctgtgcaactgagcattgatgggggcgcaaactgggtgagcgcgacgcagggtatcgaaggcgtctggggctatacctggccaacggatatgggcgatggaaaacacaccctaaccgtcatggtcaccgacagagcgggcaatacggcgacgcaaacgcttgaatttttcatcgacacccggttgtcgacgccgaccattgcgctggatagcacggatgataccggtacgcctggcgatgatatgaccaatcgcacccgaccgacctttattctgcagaatatcgattcggatgttatcaacgttacagtcagcgtcacgcataatggaacgacaacctcgtttactgcgacacagggggctggaggatggagctttacaccgccagcgccgtggggcgacggtgattatacgctgacggtgacagtggaggatcgggcgggaaatacgcgtccgtctacgccgctgacggtgacagtggatacgcaaatagccattgatcgtattgaattagtcaacgatagcggcgtccctggcgataatgtgacaaaacatgtgcgtccgcagttccagatctcggtaccggatgatgtggaaaaggttcttctgagtattgacggcggcacgacctgggttactgcaatcaagagttcgacggctggcatttgggattacacctggccgacggatatgccagagggacagcataccctgaccgtggaagtgactgacggtgcgggtaataagatgacggagacgctcaatttcactatcgatatcacgttgttaacgccaaccattgagctagcgcccgatcaggataccggacagaataagaacgataatctgaccagcgtcactcagccggtatttgtgttggggagtatcgataaagatgttcgacacgtggaattgagtattgagcataacggcacgtttaaaacggtggtactcaccgaatcagccgacggctggcgctatcgaccggattctgctttggcggacggtagctacacattcaccgtgacggtaacagatgtggcaggcaaccagcaaacatccgcgcctttaaaggtgacgatagacggtacgttgactacgccggtgattgaactggcagctggcgaagatagcggtactgttggcgatcgcctcaccaatcacgatcggcctgtgttcgacatacatcaggttgattctgacgttacgcgcgtgatggtcaaagtaacttacaacggtaaaacgcacgaggaagcggcggtattcaccaatggtcaatggcgctttacgccttctgcgagctgggctgatggctcatatcagttagccgttgtggtggaagatctggcggggaatgtaaaagagtctgcgccgtttgaggtgcgtattgataccacgacaaccattaacaatatcgtattgcttaatgataccggcgtgcagaatgatcaattaacgaatgttgccaaaccgtcattcagaattgacgttcccggtgatgtcgtccaggtacgtgtaaccctggatggtggcgctaactggaatgtgatacgcaaaaatgccgacggacagtggatttttgacagcccgaatactctggttgacggcacatatacccttcgcgtagaggccacggatgaggcaggtaatattgcgaataaagatttagtatttaatatcgatactaatatacaggttcctactattgctttagacgcaggacaagataccggagcgaataccgccgataatattactaatatttcacgacccacctttacgattggtaatgttgaccccgatgttatcaaagtcgtggtgacgattgatggtcatgattataacgcgactaaggttggggctggttggcaatttacaccaggcaatgccattccggatggttcttataatattaccgttacggttgaagataaggccggaaataccgcgacatcgaaaccattacctgttgtgatagatacgacggctgaaattgaaagcgtcacgttggttacagatagcggtgatagcgatgtagataacattaccaaagtcgacaagccgcagtttagtattgttaccgctgatgatattacccatgtgcgcgttaaaatcgataacgccgctaattggattgaactcacaaaaggaggggatggccgctggatatttaatgtcggttcggcattacctgatgggcaacacactctcttggttgatgtgactgatatcgccggcaacgttgcgcaagaaacgctgcagtttacgattgatacgactctgcgagagccgacaattgtactcgatcccacccatgatactggtgatgatactaatgataatcttaccaggattaacaaaccggtgtttattatcggtaatgtcgataatgatgtatcacacattgtggttcatattgatggtcgggattacaccattgaaaacacaggggggaatttaacctttacgccggatcaaccgctgtctgacggtcagcatacgatctctgttaccgtaacggatattgctggtaataccaaaacatcggccgaactgcggattgaaatcgacacgcaggttcagattgacagtgttacgttaacaacagatagcggcgtcaacgatcacgataatgtcaccaatgctacccgtccctcttttgaaattgcaacgcctgatgatgtgacatcggtgctggtttctttcgatggcgtaaactggacgcccatcagtaaaaatgcggccgggcagtgggaatttactgcaggtagcgcattgcctgatggtcattatactctccatgtccaggcgacggatcgggcagggaatacggcaaattccacgctgggcttcaccgtggatacgcagattgacggcctgagcgtcgtgatgctggacgacgccggaaaggattctacggatggtattacgaatattacctctccacgttttgaaatttcagccagagaaccgctgcagagcgtgacggtaattttaaacgggaaatccagcacactgactcagggggcaggtaataaatggctgtttacccctgatacaccgttagtggatggaacttacaaaatagaaatagtggctgaagatatcgcaggtaataaaattagcaaagaggtatcattcacaatagacactattgtttctgatcccagtattgatttgctggatgcggatgatactggcgaaagcgctgttgataatattacgagtgtcactacaccacgtttcgttattggcaatgtacccgccgatattgatactgttgtaatcagaattaacggcgtttcttatccggttacggcaaatggcaataacctctgggaatttcaggttcccgttgcgttaaacgatggcgtatatgaagccgttgttgtcttcagagatattgccggaaatacttctgaaactaagctgccctttaccattgataccacgacaagcgtcagtgtcagaatggagccagcgtctgataccggaaattccaatagcgataaccttacgaataagcaaaatcccaaattcgaaggtactgcagagcccaatgcgaaactggtgattaccattgttgacgataagtcaggtcgggaggttttaaaacaaacgattacggttggcgctgatggcaactggagtgtgacgccgaatatactgccggatggcatgtataccatcaacgtcgtcgcaacagatgtcgcgggaaatactgcgcaaacgcaggaaagattcactatcgatacggttacgatcgatcccaccattcgcctttcggatccatctattgatgatcagcatgaagcaaccagcctgcgtcctgagttcaaagggtttgccgaagcgttctcgacgattatgattcagtgggatgggaaagtggtcggctcggcaaacgccaatgcgaatggcgaatggagttggacgccgccatcagtattagcgccaggctcctatgttgtgagcattgttgccaaagataaagcgggtaatgaatcgtcgcaggtcgactttcctgtcgtaatacctgttattgatgtcacgcctccaaccataaagctcagcgaggagagcgatagtggcgccttaggagactttaccacgaataataaaacgccgaccctgattgggagcacgttacctaatacgattgtgagtatttatgtggatggcgtgaaggtcggcgaggcgacagcggatacagcgggtcgatatactttccagttatcggaaatgaaagatggccattatgtcgtccaggtgggtatcgtcaaccctcgcgataatagcgaactgcgttctaccgccgttgatgtcactatcgataccgaggttgctgaactggtatggaatatatctggaatgcatgagggcggatatatcaatacggtgacgccggagattggcggcaccagtgagccaaacagcaaaatcactatctttgtgaatggcgttgaaaaagcgattgcttatacgacaggcgcaggacactggggcgtagtattacccgctttgggtaatgacggtaattatgaattaacgtttaaagttgaagacgttgccggtaatatcagagagtttggtccgcagaatgtaatactggatacagtaatttcgccgttaaccgtggtattacgcgaagctgatgacagtggcaaagttggcgactggatcaccaataaatctcatgtcaccatcgatggtactgccgaagccggaagtactttaaccatcaggaatccgcagggagtggttattgctaccctggtggtaggcaatgatggtcgatggagcgcagaattagatctgcgtgaaggtagtaatgcctttgtcgtggtatcggaagataaagcgggcaacagtcaacaaaaagagattctgatagaacatgatacgcagattgaaatcagcgatatttcattaagtcgggatactaatagcggtgataaatatgatctgattaccaataataagtctccggtactggttgccatgaccgatcccggcgcgacggtacaggtttatattaatggtgtgttacaaggcacagtagaggcgagttcgtcaggtaatattagctataccatgccggcaaatagcgccgacggcgagtatcaggtgcaatttgttgctacggatactgctggtaaccgggttgagtctgcgattacaaccgtgacaatcgattctcaaattgctgtctttgatattgatgaagattcattaccggccctctctaataaccgagcgttgtcagtctcaggtgtcggggaggctggttctcaggtcagcatctttgtcgatggtaaattagtcaacgttgttatggttgaggctgatggcacatggcgcgcgccgatactgctgcaagatgatggtacgtttaatattcatttcagcattactgacgttgctggcaacactgaagtgagcaaggattatagcgtggatgtcgattcatcaaccgacttcccaacgctcaaccttgaagatgcaagcaactctggttcacttgacgatctgattactaatcacaacaagcctgtattagttggcaccgcagaagcgggagccacaatccatatttatgtggatgaaaagatcgtggcaaatgttcttgtgcttgaagatggaacctggtcctatcagtttgataatgcgttaaaagatggtgaatattctatccgtgtggttgccgaagacccggcaggtaatacggcagaatcgcctcgcttactcgtcacgatagataccagtacgtttatcgataatcctgctatggtggcaggttctgataatggtattttcagtaatgatagtataacgagtcagacccggcctacgtttagtatttttggagaaatgaaccagagtgttcagattttcattgatggagtgctagtcgatacgatcacggtgaccgacagaaatcaagtttatcgacctgagtcaccgttgggcgatggttcccatagcatttattatgttatcaccgataaagcaggcaacacggctacctcgaaaacgctaaactttactatcgatacctttaatacgacgcctgtcgccattgattctatcggtggacaaacgttagcagagatgaccggtagtgatggcaaaatatatataacggacacgacgcgtaacttattgtttagtggcagtgccgagcccaatagcaaaatagaaatcatcattaatggcttaaatgtgggggaagtttgggttaatgaaaaaggccactggcagatgccggtgaacccgctttatttcacagaaggccaactggatatcactgttaaatctacggaccgtgctggtaacgtaaatcaggaaaagtattccatttgggttgatacgcatatcaaggtatttaccagcgagcttgatgacaataaatcatcatcgaaaacggaatggtggagtaatagcgatctcattaccatgcgaggcacgggtgaaattggcgctacggtatcattaatcgtggctggcgtcacgctggcaactgctgttgtggcggcaacaggacgatgggaattatcaacagacaagcttccagaagggacttacgatattagtttggtcattgaagatagcgccggaaatcgttgggaagatgtgcgtgaaatatttattgaccgaacgccgccaaatgctccggtcgtaacgtattcagatattgtcaacgatctaattattatgcaggggacggcggaagccaaatctcagctaataataaccgatagtgaggggaatacttatacgttaaccgttcctgataatggtaaatggagtatggctatcccgtatccatcagaagggaagtttaccattacgagtgtggatgctattggtaaccggagtgatgatgtccctctcgatatcatgaaagaggttcccgttatttcattatctccagactcagacagtggtacggtgggcgataatattacgcgagataagcaacctacctttattatcgggaatctggaaagcgatgttgtggtcgttcaggtcgatatcaatgggaccgtatataatgctgaaaaaaatgccgatggcgtttggttctttacgccaggtacaccgttagctgatggttcctatacgatatcggtaatcgcaagcgatgccgcgggtaatcagaaaaactcgttacccattactgtcacgatcgacagcacgctgacggtgccggagattgcgttggcagcaggtgaagacaatggcgcttcagacagcgataacgtgacgaatcacacccagcctaagttcacgctgcagcatattgatgctgatgtgaccggggtgaccgtaaacgtgacgcataatggcgtgacagacatctatcaggcgacgcaaggcgcggatggctggaccttcacgccgccagccgcctggaatgacggtaactacacgctgagcgtgacggtggtggatcgcgcggggaattcacagcaatctgcttcgctagcggtgacggttgactcaacggtgacggtaacagcggatagccagcatgacgatgcgagcgatgacgccacggcaacagcggttactccaccggagtctgaaacagtgaatgccgaaagcgctacgcatcttcgtacagagccgtctgcggcggaagaaagcgtggtgaaggtgacagcctatagtattacattgttaaacgctgactctggggatgaaatagatcgttcaattagtcagacaccttcttttgaaatatcagtacctgagaatattgttaatgtcagtattatgtttgaaggagaagagtttactctgccgataactaaccagaaagcaatattcgaagttccgctatctttggaagatggtgaatatactatggacgtgaaattcattgataaagacaatgatttcctgattaaggagaaaacattctcagtcgatcactcctcggcggatattgtgaacgcaatgaatgtaagaggaaagaccgaggatgatattaatgattccccttccacgagttctgtagggcacaacaataacggcgctattgatgttttcgccgttaatgaagttacgctacctgtagataatcaagaagaacacgcataataacggaggcccctcacctttgggtgagggggtttacttatggataaaaaactagaaccttattatttaagtgcggaaacggcattatctatagtgtctaaaaaattcaacataaaaattgacatcaaagaggatgatataaatttaagatttaaaaagtacgacagaaataacactgacgactctatacaaatgaagaatttctttttgtcgttagggctttctctacaggatatattatttaataatggtgaggatttactaaatgagcctatgccgattttactattaacaccagaaatgaagtggatggtgtgtgtgagtggcgggcaaaaaataaagttggtaaacgcgcgcggtgaactctgttatgttgaaattgaagatgaatatttaaaagagttatctgcatttagtatactacctttaaataaagttgttgatagtataagagtaaaaaatatcataaaaaactctttatcgatgaacaagattttttatactaaatactttttttcatctctttttatggcaatttttgcgttaactatcccagtatttagtaatctgttctatgataagcttgttccaagcgcttcggtttcatctttatttggcgtggctataattgttgctgtatttattgtttttgagtttatccttcgtacttcgaaagatatttatcagtctatcacagcaaggcaggatgacgtcgatattgatatcgcatttcttgaagcggtactttatagtaaaaagaaaaatggcagatccatgtcatcagcatttgtgctatggaatgagtttcagaaaattaaacccgttttattaaactcgatctttcaacgtatagccgatattccaatatttattatatttctcattgttatatatgtaaatttaggtctggttgttattgtacctattaccatgtttatcgtctctattattatttccctcgttaaccaccattatactaatgagttaatgaacaaacaaaaagaaggacagaagaacaggaatatttttatctcagaagttttcttatctattaaaatgatccataccttaaataatcaaggtttactttttgattgggttaatacatcaaatgaacagtcgtatcttaacctgaagataaggaaattaaatcttatctatcaatctatattggggagtatgtcatctattacccaaataactattatggtaatagccttttttatggtaatcaagggtgatgttactactggcgcaattgtttcatctgtcattgtctctggccgtatttccgggatcatttcgaatttttcttctacattaatctctattttatcagcagaaaaaaccggtaaggatctgctttctttttttgatgaagatcaggcagaaaaaacaccggcattacagtcaatatcaaagtgcaatggcgatatctctatccggggcgtgagttatcagtatgatgctcaatctccgatgattattaaccgactgtctatagacatacctgcggggcaacgtgtcgcggtggtaggcgaatgcggagcaggaaaaagctcattactgggaatgctatctggctacctttcgccaacagacggtgccattttatatgatggatataacttaggacatttatcgcagaactttttttctcagcatttaagcgtggtgacgacacatgatgttttattcaccggaaccattgaaagtaatttcgcgttaaaaccgcaaaacgacaggggccgggtactcaaggcgcttcagctggcgaactgtggttttatcttgcaacatcctatggggctgaagtttccggtgaattttatggctaaaaacctgtcatccggacagcagcagcagttattattagcacgtagtctgagtagtgacgccagcgtctttttatgggatgaaccaacatcaaatctggatgagaataccgagaagcaaatttttgataacttagatgagtttattcatgggaaaacgttgatcatggtgacgcatcgtcgatatctgataaagtattttgaccgggtcctggtaatgaaaggtggaaaaataatccgtgattgttctccggataaattattaatgtaaaataagcagcgcttgtcgctgttatcaggtggtactgcttaataaaaaagacccgttgcacaaacgggtcttttttgtcatttaacgagtcggcaacgtcttcaataagtttagctcgattctgttagggctattccacttgccatttttggataaccacacctggcggccctcatcaacggcaatgcgagggacgtgatggtgcgcaaggctacccctggcgcgcgattccgcgttgagataaccggtgggcggcttcagcggcagcgatagcgtatcaggtcagcaccatcggccattctggcggggtctggctcatcgtttcgaccattacggcttcaatgttatgccagatcgcagcgagatccatcatggtaataccgagtaaaccggtggcaaaccagcaggcggataccacgcccagaccgctactgatcaccgccagaccaatataatctgatttacggaaacggatattgagcgtgctggctaaaaacatgagcacggcgctcagcagttgccagcggagaagaacgacaccagtggttatggcagccatgaaacatttcctctgaatagacctttgtccaggacagcacggcgttgttcccgggaaacgtgggacattctggctatcaacggacatcacatcaacatcgaatgaaacattgtttctatttcattgtttttgtgaactatatcacaaaaaccagcttgttcgccagatcggcaatgtattttttgtgcgttttataaccgtattttttgtgtgacttctacgcgtccgtagagaaactgccggaaagcaaagatgtattattactactcttttattttttttcgtgaaattcagacctgataaaaatatcaagttatttatcaaaagaaaggagtaaagatgtataccccatcgtttacttgagtataaatctgatattatcaaaaatatttagtgtcctgcctggtatgcgaaagagattgcgcgtagttattaatggtaaatgttgatcggtaaaagtctgttgctaatattgataaattcatgcaccgtaaacctccatttggttcacgtcttattttgccaacaatagtcacaaataatgcagggaaataggctgaaaatgagtcaaagcacacgacgcaaggtgttgagatttctcggaacgatcattgtggtgttacttcctatattgctggcgatctggtttgctcatatccgggcagtctctgaaaccagaaatcagttacattcatttgcgcagttggtattagataaaacggagcgggttatcctgcaagcagatttagcccgcgatgccgctgaacaatatcaggggcaagcctgtacgccagcccatcaacagcgaatgctgaatattatccgcggtcgtttgtacattaatgagttgatttatgctaagggccagcgttttctatgctctacggttatgacgccaacaagtccttattttattccccgcgctgactataaacgaaagcctgacatcgctatttattactatcgtgatacgccttttttcaacggttataaaatgacatatatgcagcggggaaactatgtcgcggttatcaatcccttatcttatagcgaggtgatgtcagacgatccggcgttggcctggggaatgtatgatacggtgaccaacacctttttctccctgagtgaacaggcgcaggctgatcagctattacctttggtacgacggagtgaacctgtgttccaacagggtgagcgtttttatactctggttaaatcagcaaaacgaccggttgccgcgattgtgtcaacctcaaagcaacgcttttaccagaacctctttcatcagcttacgttaacgctaccgttagggatcatctgtagcattatcatcttatttatgtggtcacgatcccggcaggcatattactcaccgcgtcgattgctgcaacgggccattaccaggcaccagctttgccttcattatcagccgatcattgatatccgaaacgggacatgtgtaggtgccgaagcgctattgcgttggccgggctatcacggtccggtgatgagcccgtgcgaatttattccgctggcggaaaaagaggggatgattgagcagatcaccgattatgtcgtcgaagaggtatttaatgatttaggtggttttctggccgcgcacccgcatctttatgtctctatcaatctcgctgccgccgattttctctcttcccgactaattgtgatgattcatgaaaaaacgcgtcagcattcagtgcttgcgcaacagataaaggttgaagtgactgagcgcggatttattgatgtgcctaaaatgacgccgattattcaggcgtttcgccaggcgggatacgaggtggcaattgatgactttggtaccggctattcgaacttgcataacctgtactcattaaatatcgaccttttaaaaattgataaatcttttgtcgacacgctaaccactaatagcgccagccatttgattgtggaacatattattgaaatggcgcaaagtttgcggctaaaaatcattgctgagggggttgaaacggctgaacaggttagctggttgctaaaacgcggcgttcagtattgtcagggatggcactttgcgaaggcgttaccaccgcaggaattcatcgcctggctacaacaaacgcccgcgcctctgacgatacgcgggcagacgccctacaggcggtgacggtaatcgctgggagtgcgatcgaactcgcggcggaatacacgcgagaaggtttgctgcgatacatagcccaggtccatcgcgatatcaaaaatcgggcgctcggtcgttcgtagctcaacggccgccaacaggagacggcgctggcgaatatactcgcctaatgtttgatgcgttaccgtacgaaacatccgctgcaaataccacttggagtagcccgatttttttgccaccacatcaatgtttagcggttggtcgatatgttcatcaatccattcgataagggtctgaattatctgctgatgcgacatattgttgcctcttaaacagtattcgattcgtcgttttgtctgcgggcgagtataattcctcaagttaacttgaggtaaagcgatttatggaaaaaaaatctccccgtttaaaagccttactgacgccgggggaagttgcgaaacgtagcggtgttgctgtgtccgccctgcacttctatgaaagcaaagggctaattaccagtatccgtaatagcggtaaccaacggcgatacaagcgtgacgtgttgcgttatgtcgcgattatcaagatcgcccagcgtatcggcatcccgctggcaactatcggcgacgcgtttggtatcttgccggaaggacatacgttaagcgcgaaagagtggaagcagctctcatcgcagtggcgcgaagagttagaccgacgtattcatacgctggtggcgttgcgcgatgagctggacggttgtatcggctgcggctgtttatcgcgtagcgactgtccgctgcgaaatccaggcgacaggcttggcgaacacgggacgggcgcccggctgcttgaagatgattaacatgcactcggccatcgggctgagctcacctaaaactaaagcgccgctaagggcgctttagtttgtttccggtctttgtctttcgctctatcccgctgattacaggagggtttcccccgacgtcaacacccctcatatcgagcacgtggtggaggttccggtttgtgttgatactgtaagtgtaagcgacgacgccctgttcgccagcgaaatgctgattttttagccgaaatttttacggcaactgccataattttctatagttagttggcataccttacaggagacagccatgctgacggtgcaccatttaaatcagtctcgttcgcagcgcatcttgtgggcgctggaagagctggcgttgccttaccagattgtgcgttaccagcgtgaaaagaccatgctggcgccgccggcattgaaaaaagtgcatccgctgggcaagtctccggttatcgaagatcacggtatggttattgcggaatcgggcgccatcctggaatatttgcaggacacttacgacagtatcggacgctttaaacctgcggatgcgcaggggaaacaacactatcgcttctggctacattacgctgaaggttctctcatgcccttgctattgatgagactgctctttacctctctgggtaaaccgccggtaccattgggcctgcgaacgttgggcggcgttatcggtaagggcgcgcaaaaagcgtacctcaatccgcaactggaaacccatgcgcgctttattgacgggcatctggcaaatcacccctggtttgccggagagcagttaagtatggcggatatccagatgagcttcccgctatttgcgctgcttgcccgaggcggaatcgctcatctcgaccatatcaacgcatggaaagcgcgggtagaaatgcgtccagcctggcagcgagcgattcagcagggcggtccgtttaccattcccggcggataatggcgtttttgtgagcagattgcgcaacgtatttgctaacagcgatgcgaaaaattgttgctggattgcgcagggacgataacgtttgcgcatcgtctggcgatttattgagcatactaagcagaaaagcataaaaagcggcaaagttcagttgaaaaagcgttgatgatcgctggataatcgtttgcttttttttgccacccgttttgtatacgtggagctaaacgtttgcttttttgcggcgccccggttgtcgtaaatgtagcacaaggagataacgttgcgctgttagtggattacctcccacgtataccgacgaataataaattctcaggggatgttttctatgtctacgccttcagcgcgtaccggcggttcactcgacgcctggtttaaaatttcacaacgcgggagcaccgttcgccaggaagtcgttgctggcttaaccacgtttctcgcgatggtttactccgtcatcgtggtgccagggatgctgggtaaagccgggttcccgcctgctgccgtctttgtagcgacctgcctggtcgcaggcgtcggctctattgttatggggctttgggcgaatctgccgctggctatcggttgcgctatctcgttgacggcgtttaccgcgtttagcttggtcctggggcagcatattagcgtcccggtcgcgcttggcgccgtattcctgatgggcgtactgtttaccgttatctccgccaccggcattcgtagctggattttgcgtaacttgccgcagggcgtggcccacggaaccggtatcggtattggcctgtttttgttgctgattgccgccaacggcgtcggcctggtcattaaaaacccgctggatggcctgccggtcgcgctgggcgatttcgataccttcccggtgattatgtcgcttgtgggtctggctgttattctcggtctggaaaagctgaaagtccccggcggcattctgttgaccattattggcatttctattgtgggtttgctcttcgatcctaacgtccatttttccggcattttcgccatgccttcgttgagcgatgaaaacggcaactcgctgatcggcagcctggatattatgggcgcgttaaaccctgtcgttctgccaagcgtactggcgctggtgatgacggcggtgtttgatgcgaccggcacgattcgtgcggtcgcagggcaggctaatctgctggacaaagacggacaaattatcgatggcggcaaagcgctaaccaccgactcactgagtagcgttttctccggcctggtcggggcggcgccagccgcggtgtatatcgagtctgcggccggtacggcggcgggcggtaaaacgggcctgacggcgattaccgtgggcgtgctgtttttgctgatcctgtttctttcgccgctctcttatctcgttcccgtctatgcaactgccccggcgctcatgtatgtcggtctgctgatgctgagtaacgtggcgaaaatcgattttgctgatttcgtcgatgcgatggcggggctggtaacggccgtatttattgtactgacctgtaacatcgtcaccgggattatgatcggctttgccacgctggtcgtcgggcgtctggtttccggcgaatggcgtaaactgaatatcgggactgtcgtcattgcggtcgcgctggtcgctttttatgccggcggctgggctatctagctctgccttcattctgaaaaacgggcggcgttggccgcccgttttcattttcaggacacatcacgttaccttttgcgttaatctgaagaaggtgaaaccgaggcatgatgcctctctccatcataaaaaacatcgcaaacagggaacgcatggaaattttcttcacaatactcatcatgacccttgtggtctcgctgtcgggggtatttacgcgtgtattacccttccagcttcctttaccccttatgcagatcgccgttggcgcgctgttggcgtggccgacgtttggtttgcatgtggaattcgacccggaactcttcctggtgctgtttattccgccgctgctgtttgcggatggctggaaaacgccgacccgtgaatttcttgagcatggacgagagattttcgggctggcgctggcgctggtcctggtaacggtcgttggaatcggcttcctgatttattggctggtgcccggcattccgctgatccccgcctttgcactggccgccgtgctgtcgccgaccgatgcggtagcgctctccggaattgtgggcgaggggcgtatcccgaaaaaaatcatgggcattctgcagggagaggcgttaatgaacgacgcctccggtctggtatcgctgaaattcgccgtcgcggtggcgatggggacgatggtctttaccgtcggcggcgcgacgctggaattttttaaggtcgctatcggcggtattctggcgggttttgtagtcagttggctgtatggccgctcgctgcgttttttgagccgctggggtggcgatgaacccgcgactcaaatcgtcctgctgtttctgctgcccttcgcgtcttacctgattgccgaacatattggcgtctcaggcatcctggccgcggttgccgccgggatgaccatcacccgttctggcgtaatgcgccgcgcgccgctggcaatgcgtttgcgcgcgaacagtacctgggcgatgctggaatttgtctttaacggtatggtctttctgctgttgggactgcaattgccagggattctggaatcttcgctggcggcggcggaagctgacccgaatgtcgaaacctggatgctctttaccgatatcgtgctgatttatgcggcattgatgctggttcgcttcggctggctgtggaccatgaaaaagttcagcctgcgctttttgaagaagaaaccgatggagttcgccagctggacgtcgcgtgaaattctgattgcttccttcgctggcgttcgtggggcgatcaccctggctggtgtgctctctataccgttacttttgccggatggcagcggatttccggcgcgttatgaactggtattcctggcggctggcgtcattctgttctcgttatttgtcggcgtgatcatgctgccgctgctgttgcaacatctggaagtcgccgatcatgcgcaacagttgaaagaggagcgtatcgcccgcgcggcgacggcggaagtggcgattgtcgccattcagaaaatggaagagcgtctggcggcggataccgaagaaaacatcgataatcagttgcttactgaagtaagctcacgtgtcattggtaacttgcgtcgccgtgccgatgggcgaaacgatgtcgaaagctccatacaggaagaaaacctggagcgacgtttccgtctggcggcgctgcgttccgagcgcgccgagttgtatcatctgcgcgccacgcgagaaatcagcaatgaaacattgcaaaagctgctgcacgacctggatttgatggaagcgctactgatagaaaatcagtagtccttgtggcccggtggcgccatgctttccgggcctacaagtaggccggataaggtgcttgcgccgccatccggcaagggtcttaacccatggcttacggttgtttcagccaaaacccttcgcaacaggttaaccatgcccgggcgctgtgcgacagatacacgccctctcgccaaatcatgcccaactgccagcggagatcgctttccagcggtagccagcgcagcgtggccttatccagacgctgacaaatcggctccggcaaaatggcgatgccgacgcccgcttgcaccatggcggcgagaaaatcccattgcccgctgcgcacggcaatccgtggttttacgtcatgctggctaaataaggtcatcaactggcggctcagggcaaagtcttcgttatagataagaagaggatgctccgccagagcttcaggcgcgatggagtcgccggttgtccactgaccggaacggggaaccagcacgcacagcggatggctgaacagcgataacgtcgtcagcccgctcgcttcttccaccgggagcgcggtcatcgcaacatccagctcgccattcattaccgcctgctgtaccgtcaggccgccaaactccgaaattttgagttcaacgccagggtagcgttgtcgaaacaaactgattggcccggccatcaacatgccgaccatcgggggaatacccagccgcagcacgcccttattgagatggttaatatcgctcaactcggcctctaactggcgaaactcagcgaggatcgccagaccgcgttcaaacaccacgcgtccggtatcggtcagcaataacttacgtccgtcgcggatcagtagcgtacagttaagctcatcttcaagatttttcagcattttgctaatggtgggctgggtgacaaataacttctccgctgcgcgggtgaaactttgctggcgcaccacctcgacaaaataacgcagcgttctgatatccatgattattccttccgactatgcctgcaatgattttaattcatttctgcccgtgacggaggttctctatactggcgctccgtattatttttcaggacattccctcatggctgtggcgataagccgcgttacgcctgccgttgtgcaacgactccaggtaccggttcaggtactgctctatgcaggtttattcattttttcccaatatcttgtctcctggctgcacctgccgttgcccgcgaatctggtcggcatggtgcttatgttggcgctgatcgtttgccggattattccgcttagctgggtacgcgcaggcgcacgctggctgctggcggagatgctgttattctttgttcccgccgtcgtggcggtagtgaactatgcccatctgttactggtggacggctggcgcattttctcggtgatagcgatcagtaccttaatggtactcggcgcgacggcgtgggtggtggataaagtgtatcgctatgagatgagcaggctaaaccgtgaataacgttcagttaagcgtactgtgcctggtgattacgctgggaatttatttcgccaataagcgcctgtatcgccgttttcgcaaattgccgttgatgccattagtgctgacgccggcactgctggtgttaatgctggtgttcggtcatatctcctggcaaaactacattggtgaatcgcactggctattgtggctgctcggcccggcgaccattgcctttgcggtgccggtgtacgataacctcgcgattatcaaacgtcactggatgtcgctcaccgcgggcgtagtgacggcgacggtggtggcagtcaccagttccgtttggctggcgcgtctgttcacgttatcggatgagattcagcgtagtctggcggtacgttccgttaccacgccgtttgcgctggcggcggcagaacccctgggcgggcagccagatctggtggcgctgttcgtggtcgtcactggcgtgtttggcatggcggtcggcgacgcgctatttttgcgtctctctatccgggaaggcatggcaaaaggggcaggattcggcgcggcgtcacatggggcgggcacggcgcgttcctatgaacttggtcagcaggagggcgtcgtcgccagtctggtaatgatgctgtccggcgtggtgatggtgctggcagccccgctggtggcgagggtgatgttctgattttcctccgacccacagggccggaggaaacggtaagattaatgcgcacgcccttgttgtacgccgaatcccgtttgggagcggataaactgagcgcggaactgctcacgttcacggttgccttctgccgagttatcggtggccgagaagaaccagatccccaggaacgccacgctgatagagaacagcgccggatactcatacgggaagatcgctttttcgtggccgaggatctgcacccaaatggtagggccaagaatcatcagcaccaccgctgtcagtaaacctaaccagccgcccagcatagcgccgcgcgtggtcagttttgaccagtacatggaaagcagaatgatggggaagttgcagctcgcggcgatagcaaatgccaggcccaccataaaggcgatgttctgattttcaaacaggacgccgaggataatggcgatcacgcccagcaccaggacggtgattttcgacaccttcagctcttcacgttcggttgcgcctttgcggaacacgttggcgtacaagtcatgcgacaccgccgatgcgcccgccagcgtcagacctgcgaccaccgccagaatggtggcaaacgccactgccgaaataaagccgaggaacaggttgccgcctaccgcgttggccagatgcaccgccgccatgttattgccgccaatcagcgcgcctgcggcatctttataggcgggattcgcccccaccagcatgatagcgccgaagccgataataaaggtcagaatgtagaaatagcccataaaaccggtggcgtagaacacgctcttgcgcgcttcgcgggcatcgctgaccgtaaagaaacgcatcagaatatgcggcaagccggcggtgccgaacatcagtcccagacccaacgacaatgccgaaatcggatcttgcaccaatcctcctgggctcataatcgccgtgcctttcgggtgtaccgccatggcttcggtaaacagattattgaagctaaagccgacgtgtttcatcaccataaaggccataaaactggcgccaaacagcaacaggacggctttgataatttgcacccacgttgtcgccagcatcccgccgaacagcacgtacatcatcatcagcacgccgaccagcaccacagcgatgtgatagttgaggccgaacagcagttcaatcagtttaccggcgccgaccatttgggcgatgagataaagcgccaccactaccagggagccacaggccgaaagaatacggattggcccctgtttcaggcgataagaggcaacgtcagcaaaagtataacgtcccagattacgcaggcgctcggcaatcaaaaacaggatgattggccagccgacaaggaagcccagcgaatagatcagcccgtcataaccggaggtaaacaccagcgcggaaatgccgagaaatgacgcggcagacatatagtcgccggcaatcgccaggccgttctggaacccggtgatattgccgccagcggtgtagtagtcgctacgggaacgtacgcgtttagaggcccagtaggtaataccgagcgtaaacacgacgaaaatcaaaaacatgataatcgcctgccagttggtgggctggcgttcaaccgcgccgctaatggcatccgccgcatgagcggcgaaggggagtgcggcggcaagcgccgtcagaactctcttcataatactttcacctcatgcagtacggcgttattaagacgatcgaattcgccgttcgcccgccagatataaattccggtcaacacaaaagaaatcacaatcaccccgacgccaatgggaattcctcgggtgacgctggttcccgcatgtagaggcgtgcccagccagccaggcgcgaaggcgatcagtaaaataaagctgatataaaccgccagcatgataaccgacagaatcgtggcaaaccgttgccgtttttcaactaattccctgaaacgcgcactgtcttctatccgctgataaatttggtcattcatcacagagctctccagaggtccccctgcgtctttcgcgctacaggcgcgttggccgcactcgcgcgccccagccacatagtgaacttgaactatgctgctgagggtgtgctcgcttgccgccttcctgtaacacgaaatcctttgggggagggttttttatatttccctctcccggtttgagagagggcaggggtagggtcgtaggccggataaaacgcgttcgcgttgccatccggcatttatggttatgacggcatcgcgatggcctgcttctcttcgagcagtttctccaccacgccaggatcggcgagagtcgaggtatcgcccagattgctggtatcgcccgccgcgattttgcgcaaaatgcggcgcataattttgccggaacgggtttttggcagtgagtcggtccagtgcagcacgtccggcgtcgccagtgggccaatctctttacgtacccagttgcgcacctccgcgtacagttctggcgacggctcctcgccgtggttgagcgtcacataagcgtaaatcgcctggcctttgatagcgtgtggaatacccaccaccgccgcttcggcgatcttcggatgcgccaccagcgctgactcgatttccgccgtacccagacggtggccggagacgtttaacacgtcgtccacgcgaccggtgatccagtaatagccgtcctcatcgcgacgcgcgccgtcgccgctgaaatacatattcttaaaggtagagaaataggtctgctcaaaacgttcatgatcgccgaacagagtgcgcgcctggcccggccaggaatcggtgatgaccagattgccttccgtcgcgccttcttgcggatggccttcgttatccaccagcgcaggctgtacgccaaagaaaggacgggtggcggaaccggctttcagttcgatagcgcctggtagcggcgtgatcataaaaccgcctgtttcagtctgccaccaggtgtcgacgaccggacatttttccttgccgatcttcttccagtaccattcccacgcttcgggattgatcggctcgccgacggaacccagaatgcgcagtgaagaacggtcggtgccttcaatggctttatcgccttccgccatcagcgcgcggatggccgtcggggcggtatagagaatgttgacctggtgtttgtcgaccacctggcacatgcgagcgggcgttggccaattcggcacgccttcaaacattaaggtggtcgcgccgcaggccagcgggccatacaacagatagctgtgccccgtcacccaacccacatcggcggtacaccagtaaatatcgccagggtgataatcaaagacatacttaaaggtggtcgcggcgtagaccagatagccgccggtggtgtgcagcacgcctttcggcttgccggtggagccggaggtataaaggataaacagcggatcttcggcattcatcgcttcaggctggtgctcagggctggctttttcaatcaaatcgcgccaccacaggtcgcggccttcttgccagtcaatgtcgctgccggtgcgcttcaggacgatcacatgctcaacgctagtgacattcgggtttttcagcgcgtcatcgacattctttttcagcgggatactgcgtccggcacgtacaccttcgtcagcggtgatcaccagccgcgagctggagtcgataatgcgtccggcgacggcttccggcgagaagcccccgaagatcaccgaatgcaccgcaccgatgcgggcgcaggccaacattgccaccgccgcttccggcaccatcggcatataaatcgctaccacatcgccttttttaatgcccagatccagcagcgtattcgcgaaacggcagacatcgcgatgcagttcgcgataagagatatgtttactctgcgacgtgtcatcgccttcccagataatggcggtgcgatcgccattttcctgcaaatggcggtcaagacagttcgccgccagattcagcgtgccgtcctcgtaccatttaatcgacacattgcctggcgcaaaggaggtgtttttcactttttggtacggcgtgatccaatcgagaatttttccctgttcgccccaaaacgtatcggggtcgttaatagactgtttatatttagtctcatactgctctggatttatcaggcaacgatccgcaatgttggcgggaatggcgtgtttatgtgtttggctcatgctgttgttctccttgtaggatgttaataatatgtcgcataaacgttaaatgtagggtcttaataagttttgtttagtatttgggcgacagatcacgcaaaaagggaactgtgcaaataagcagcaatctattttttgattgtgtcccgcaaaattagataaattttcgggataacatgacgttatatgaaattttttaaaaaagtgatccgtgtccggaaatcagaaaagagagggagttttgtccaggttactaactctaaagtggtattttacatacacttacaattgattaaagacaacattttaagtgtggttatttgttacacatagaggagatcaatgtaataacagtatttgtgcggttgctgttatggaaaacgataaaaaatcgccattaaagataatggcgcaatctggatgagacctctatggcaaggaaaacactacgcgcacgccgtttcttcagccttatatttccttttttcttcattacctctgtttacgctgagcaaacgcctgaatccgcaaaaaccgttactgttgaagcgaaaaatgaaatgttcgcgcctcaacaccccgaccaatatcagtcatggaaagcgacgtcagaacagtctgcccgtgaagatgcgctggcggaagaccctcgtctggtgatcctgtgggcgggctatcccttctcccgtgattacaacaaaccacgcggccacgcgtatgcggtaactgacgtgcgcgaaacgctgcgtaccggcgcgccaaaaacggcggaagacggcccgctgccgatggcctgctggagttgtaaaagccccgatgtcgcgcgccttatccaacaagaaggcgaagacggctacttccatggcaaatgggcgcgcggcggcccggaaattgtcaacgatttgggctgtgccgactgtcataacaccgcgtcggacgatttcgcccaggggaagccagcgttaacgttgtcgcgcccctatgccgaacgggcgatggaggctatcggcaaaccgtttgataaagcgggacgatttgatcagcaatcgatggtctgcggtcagtgccacgtggagtactactttgacggtaaaaacaaagccgttaagttcccgtgggatgagggcatgaaggtcgaaaatatggagcaatactacgacactatcgccttctctgactggactaactctctgtcgaaaaccccgatgctcaaagcgcagcacccggaatatgaaacctggagcgcgggcattcacggtaagaacaacgtgacctgtatcgactgccacatgccgaaagtacagaacgccgaaggcaagctctacaccgaccataaaatcggcaacccgttcgacaatttcgcgcaaacctgcgccaactgccacacccaggacaaagcgtccctgcaaaaagtggtcgccgagcgtaaacaggcgattcatgacctgaaaatcaaggttgaagatcagctggtacatgcgcacttcgaagcgaaagccgcatgggatgcgggggcgacagacgcggaaatgaaaccgattctgaacgatattcgccacgcgcagtggcgttgggatctggcgattgcgtcacacggtattcatatgcatgccccggaagaaggtctacggatgttaggcagtgcgatggataaagccgcggatgcccgtactaaactggcgcgactgctggcgaccaaaggcattacccatgaaattccgctgccggatatttcgacgaaagagaaggcgcagaaagcgattggtttgaatatgcaacaaatcaacgcggagaagcaggacttcctgaaaacggtcgtaccgcagtgggaagatcaggcgcgtaaaaacggtctgttaagccaataacctcacatgtgacaaatttgccggatgacagcgcaagcgctttatccggcctacagaagtcttgtaggccttaaagctgcgcgccatcaggcattatgtaatggagtgaatatgagcgtattacgttcgttattaactgctggggtgctggcgtcaggcctgttctggagcctgagtggaattactgccacgccaacgccgcaggagtcggatcaacgctggacggtcacccagcagcgtaatccggatgctgcctgtctggactgtcacaagccggacaccgaaggtatgcacggtaaacatacgggcgctatcaacccgaacaataaattgccgataacctgtaccaactgccacggtcaaccgtcgcttcaccaccgtgaaggggtgaaagatgtgatgcgttttaacgacccgatgtatacggtagagcagcagaacagcgtctgtatgtcctgccacttgcctgaacaactgcaaaaagcgttctggccgcacgatgttcatgttactaaagtgacctgcgccagttgccattccctgcatccgcagcaagacacgatgcagacgctaagcgagaaagggcggatcaaaatatgcgtggattgccacagcgatcagcgtactaacccgcactttaatccggcgtccgttccgttgcttaaggagcagccatgagttgcacccgacgtcaatttattacccgcgtcggcgcgctggcggcggtcagtgggatggcaggacgcgttgtagcgaacacgttgaatattaatggcgtgcgttatggcatggtacacgatgagtcattatgcatcggctgcacggcctgcatggatgcctgtcgggaagtcaacaccgtgccggaaggcgtatcgcgcctgacgattattcgcagcgagccgcaggggacgtttcctgatgtgaagtatcgcttcttccgccactcgtgccagcattgcgaccatgccccctgcgttgacgtctgcccgacgggggcatcattccgcgatgccgccagcggtattgtcgacgtgaatccggacctttgcgtcggctgccagtactgcattgccgcgtgtccctaccgcgtgcgctttatccatccggtcagtaagacggcggataaatgcgatttctgccggaaaaccaacctgaaagcgggcaaacagcccgcctgcgttgagtcatgcccgacgaaggcgctgacgtttggtaatctggacgatcccaacagcgatatttcccgtttgttgcggcagaaaaccacctatcgttacaagctggcgctgggcacaaaaccgaaggtctaccgcgttccctttaactatggggaggtgagccaatgacatccgcttctgcatttcattttgcatcactggtgtgggactggcccatcgccatctatctgtttctgattggcatctccgccggactggttacgttggcgattctgctgcgccgcttccatccggaggcgggcggttcggacagtacgctgctgcgcactacgctggtgttagggccgggggcgattattcttggtctgctgattctggtctttcacctgacgcgcccgtggaccttctggaagctgatgttccactacagctttacctcggtgatgtcgatgggggtgatgctgttccagttgtacatggtagtgctggtgctgtggctggcgaaaatctttgaaaaagaggtgattgccctgcaacagcgttggctgccgcggtcagggatcgtgcagaaagtgctgacgctgatcgcgccgtttcatcgcgcgctggagacgttaatgctggtactggcggttctgctcggggcgtacaccggctttctgctgtcggcgctgaaatcctatccgttcctgaataacccgatcctgccggcgctgtttctgttctccggcatctcctccggcgcggcggtggcgctgatcgctatggcgttacgccatcgtagcaacccgcacagcaccgaggcgcgctttgtacatcgcattgaaaccccagtggtatggctggagatcttcctgctggcggccttttttatcgggctggcgctgggcgatgacggcaaaatgcgcgcgctggcggcggcgctgggcggcggattctggagctggtggttctggcttggcgtcgtagggctgggattgattatcccgctgctgctgaagccctgggcaaaccgtagcgtcacgtttcacggcgtgctggccgtttgcggcgccagtttgaccggcgtgctgctgctgcgctttttcattctttatgcgggacagctaacggttgcataatctggacatcttccttcctgaagccggatttctggcgctgttgttgagtctcggggtcaacgtgctgaccccgctggcgacgtggtgcgggatggggcagcactggcgcggcgtcatgcgcctgacgacctgcggcgcgtggacggcgttcacgctgctgctactggcgtttgcgattctggttagctgttttctgaccagcgatttttcggtcgtttatgttgcgcagcatagccatagtcagttgtcatggggactgaaactggcggcggtatggggcggtcatgaaggttcgctcctgctgtgggcgctgcttctttcggggtggacggcgctattcgcctggcgctcccggcatgaatctgacgcgctttttccgctgaccctgagcatcttgtccttcattatggcctcgctgctgctatttattgtgctgtggtccgatccgttcctgcgtattttccctcccgccatggaagggcgcgaccttaatcccatgctgcaacatctggggctgatcttacatccgccgctgctctatctgggttatggcggcctgatgaccgcggcgagcgtagcgctggcttcgctactgtgcggcggctttaacgccacaaccgcctgggtttgctggcgctgggcgttaccgggttggtgcgctctgacgctggggatcattctcggatcgtggtgggcatattgcgaactgggctggggcggctggtggttctgggacccggtggaaaatgcctcgttgttgccgtggcttgccgccagcgcgttgctgcacagtctgtatgtcagccgccagcgcgggagcttccgccactggtcgttgctgctggcgatactgacgctgatcctctcgttgctgggaacgctgattgtgcgttccggcattctgctctccgtccatgcttttgcgctggataacgtgcgcgcggtgccgctgtttatcctttttgccgcgttaagtctggcatcgcttgctctgtacggctggcgggcacgggagccgtatccggcgacgcgtttgggcggcggaaagtgcgaaacgctcattctgacgacgctgctgctctttagcgccgtcttgttgatcgtgctggtcgggacgctctaccccatgatttatggtttgatgggctggggaaggctttcggtgggcgcgccctattttaatcgcgtcacgctgccgtttggcctgctgatgctggtagttatcgtgctggcgacaatcagaagccgcaaagtctctgtgcgttgtcagcttccggcattgctggcgcatacgggcgtatttatcttcgccgccgggatcatggtttccagcggcagtcggcatgaaatcagccttaacctcagccccggtcagcaggtggtactggcgggctatacctttcgtttcgagcgtctggatctggaagccaaaggcaactacaccagtgaaaaagcgcggatcacgttgtggcggaatgaaaaacgcattggcagcctgcagcctgaaaggcgcttctatgccgcgcgtcgtcaacagatgatggagccggggattcactggaacctgctacatgactggtacgcggtgatgggcgaaaaaaccggaccggatcgttacgccatgcgcttatacgtgcagaccggcgtgcgctggatctggggtgggggattgttgatggtgtgtggagcgctgctgagcggatggcgggggaggaagcatcctgagttattgcctgatggcgctgcgcttatcaggcctacgagtgaaaagcatggtaggccggataaggcgttcacgccgccatccggcaaaacgatgttacttttggctttactgatttttctgccttttgccacccatgcccaggtggtggacacatggacgtttgccaacccgcagcagcaggagaaagcgctgtctattgccagtcagctgcgctgtccgcagtgtcagaaccagaacttgctggaatccaatgcgcccgtggcggtcagtatgcgccatcaggtttacagcatggttgccgaaggtaaaagcgaagcggaaatcaccgcctggatgaccgaccgctatggtgatttcgtgcgctacaacccgccgctgaatgagcaaacgctgctgttgtgggcgctgccgtacctgctgttattgctggtgggcgtggtggcctggcgggtgagaaagcgtcagcacgcaggagagggggaacaatgagccagtctgaacactccactgcgccgttacgtcccatgcctgtaaagcgtctggcggctgcggcggtgttgatggtggctgcctgtgtcggcggctatctgttgacgccgaaatggcaggctgtgcgtagcgagcaacagcgtctggccgatccgctacgtgactttacgaacccgcaaacgccagaggcgcagctttccaggctgcaagaaaaaatccgcgccaatccgcaggatagcgagcaatgggcgcggctgggcgagtattatctctatcgcaatgcgtatgacaatgcgctgctggcatatcgtcaggcgttgcgtctgcgaggcgataacgcgcagcttttcgccgcgctggcaacggtgctgtattaccaggccgggcaacatatgacgcctgcgacgcgtgaaatgattaataaagcgttagcgctggatgcgacagaagtgaccgcgcagatgctgctggcggcggatgcgtttatgcaggcggattatgcgcaagccgtgtcgctgtggcaaaccttactggatgccaactcgccgcgagtgaaccgcgcgcagctggtagaggccattaatttggctaaattgttacaaaatcggcagaaataattttttcttttttgtgacttttgtcatgtgtgctgtttaaaaaaacggcgaatgagacacaagtaaaaattaattacctcagtgtattattcatttttgacgaagtaaaaaactttccataacaaatagttattcatcattaacgccataaactcgcgttattatgcataaaaacagccaaaagccctgttatgaaagggttgcgcaagacgctatgcaaatgatactgattatgcgcgttaaaaaactctacaaaccaacgcaacacaaatcataccctttcagtatgtattgctctcatgctttcggcggagagcaacgcttcatcgaggaagtctgttgttatgaaaaatttgaaagtcagcctggcctggcaaattttgctggctatggtgctgggcattctgttgggcagctatctgcattatcacagtgacagtcgtgaatggctgattgccaacctgctgtcgcctgctggcgatatctttatccatctgattaaaatgatcgtcgtgccgatcgtgatctcgactctgattgtcggcatcgccggcgttggcgatgcaaaacagctaggccgtatcggcgccaaaaccattctctattttgaactgatcactacggtggcgattatcctcggcattacgctggcgaatgtctttcagccaggctcaggcattgatatgtcgcaactggcgaccgtcgatatttcgaaataccagaacaccacggcggaagtacaaagtcatgcgcatgggctgatggggacgatactgtcgctggtgccgaccaatatcatcgcatcgatggccaaaggggatatgctgccaattatctttttctcggtcctgtttgggctggggttgtcgtccctgccggcaacgcaccgcgaaccgctggtgacggtatttcgttccatctctgaaaccatgtttaaagtcacccatatggtaatgcgctatgcgccagtgggcgtttttgcgctgatcgccgtcacggtggcgaattttggtttcgcgtcgctgtggccgctggcgaaactggtgctgctggtacactttgctattatcttctttgcgcttgtagtgctgggcatcgtggcgcgcctgtgcgggttaagtatctggattctgattcgcattctgaaagatgaattgattctggcgtactcgaccgccagctccgagagcgtactgccgcgcattatcgagaagatggaagcttacggcgcgccagcctctatcaccagtttcgtggtaccgaccggttactcatttaacctcgacggctccacgttataccagagcatcgccgccatttttatcgcgcagctatacggtatcgacctgtcgttgtggcaggaaattgtactggtgctgacgctgatggtgacgtcgaaagggattgccggcgtgcctggcgtttccttcgtggtgttactggcgacgctgggaagcgtgggcattccgctggaagggctggcgtttatcgctggtgtcgaccgtatcctcgacatggcgcgtactgcgctaaatgtggtggggaatgcgctggcggtgctggtgatcgccaagtgggaacacaagtttgaccgcaaaaaagcgctggcctacgagcgcgacgtgctgggcaaatttgataagaccgcccaataacggattgccggatggcgctttgcttatccggcctacagcgaaagagaatgtaggccggataaggcgttcacgctgccacccggcaacctactccgggttgcctgatggcgctacgcttatcaggcctacaacgactacgttcatcaggcaataaacatcagccattcgttagcgtttcgaactcttcgcaaccggtatcaaacccttccagacagcttagattcaaccagtgcaacgccttctgcttattcttttcaataaagcccggttcaccgtttaaaaacatcattcccgcccagtattctgaatagccggtacgggaaatggcggaactgcgtttgaaataccaggcggctttttcatcatcggcggcaatgcccacgccgttggcgtaaatcaggccaagcaacatttgcgcatccaccgcggagtcgttatccagatcttcagaggccttttgcagcagcgagatggcttttgggtagtccgggcgcccggcctgggtgttgaccaggatccgcgccagcgtaatttctcccgctttactgcccgcgttagccgccttttcagccagctttttcgcgtcgggataatccaggcttaccggattagtgattttgatttgcgccagtagcgcgcaggcgtcggcgtcgccactgtcggcggctttttgcgcccagtattcagctttgttcaaatcgccatagctcaaccaactgtcggccagaaaatattgtgcgcgtctgtcacctgcctctgctgcctgcaaatactggctacccggctcaggatctgcggcatgggcaaagaatgtcataaacaacatcaatgcaagaagtagtttcattttgagttttatttagggtacggaaaagacagtataaagagatcgtatggataaaaaaacagcctccgggcggaggctgttatagggaaaatgcctgatggcgatgctaatgcatctaatcaggcctacagtagacgcaggccgaataaagcattctgatgccgccatccggcagatcaacccattgcgctttcgcgcaggcgggttttcagcttgttgtactcatcaatcacatactgctcggcggctcgctgatcggcgatcggctcaacgcgtacggcgcagtatttgtactccggcgttttggtaatcgggctgaggttttcagtcaccagctcgttacaggcgccaatccaccactggtaggtcatgtaaatcgcccctttgttcgggcgatcgctgacctgcgcgcgggtgatgattttacctttgcgcgaatgaacccacaccagcgcttcatcttcaatgcccagacgcgcggcgtcggcggtattgatttgcgcatagcccggttcatcggccagcgcggccagcgccgcacagttaccggtcattgagcggcaggagtagtggccgacttcgcgcaccgtcgacagtaccatcgggtactcttcggtgagtttatcgataggcgctacccagtcgcaggtgaagaactgcgccagaccgttgggggtatcgaacttctctttaaagaggtacgaggttccctgatcggcatctgacgtgtcgcggcacggccactggatataccccagctcgcccattttctcgtaagtggcgccgtagaaatccgggcacagatgacgcaactcatcccagatctcctgggtgttgttgtagtgcatcggatagcccatccgggtggcgatttcactgataatctgccagtcggttttcaggtcccacttcggctcaacggctttaaagaagcgctggaagccacggtcagccgcagagaagacgccttcatgctcgccccatgaggtagagggtaaaatcacatccgccgccgacgcggttttggtcatgaagatatcctgcacgatgaccagttctagatcctcaaacgctttacgtactgcagagagttccgcatcggtttgcagcggatcttcacccataatgtacgccgcgcgcacttcgccatgcgccgcacggtgcggcagctcgctgatgcgatagccggtatgcgcaggcagactttctacgccccaggctttagcgaacttctcgcggttttccgggaacttaacgtactggtagcccggataagtatccggcagcgcgcccatatcgcacgcgccctgaacgttgttctggccgcgaaccgggttaacgcccgcgcttggcttgccgaggttgccggtcagcatcgcgaggctggtcagtgaacgcacggtttccacaccctgatagaactgggtgacgcccataccccacaagatcgctgcgcttttcgcgctggcatacatccgcgccgcctgacgaatttcctgtgcgctcacgccagtgatctcttcgacggactccggcgtatagctttcgacaatcttactgtattcttcaaaaccttcggtacggctggcgacaaacgctttgtcgtacaggttttcttcaataatgacatgccccatggcgttgagcagcgcgatattcgagccgtttttcaacgcgatatgcatgtcagcaatgcgcgcggtttcaattttgcgcggatcgcagacgataattttcgccccgttgcgtttagcgttaatcacatgattcgccacgatagggtgggaatccgccgggttatacccgaagacgaacactaaatcagtgttatcaatttcattgatagcattactcattgcgccgttaccgaccgattggtgcagacctgcaaccgatgggccgtgtcagacgcgagcgcagcagtcaacgttattggtaccaataacggcgcgtgcgaatttttgcattacatagttggtttcatttccggtaccgcgagaggagccggttgtctggattgcatccggaccgtacttcgctttgatggcgctcaaacgttcagcgacgtaattgagcgcttcatcccaggaaacagattccagtttgccgccacgctggcgacggatcattggggttttcaggcgcggggtcaggatctgggtatcattaataaaatcccagccgtagtagcccttcagacacagggtaccctggttggttttcccctgcgccgcctcagcccggacgattttgccgttatcgaccaccagattgattttgcaacctgatgcgcaatacgggcaaaccgtgacgacttttttcatcggtttcgctccagttaatcaaatcgcgcatacgcgctgtcgccctcagtatgcatgttttatgccacttttttagtatgggctttccctgatattacgggcgaattttgctcaaaaccctgacgaaaaacaggctatcgtcagttttgacgtgtcgaaagaaaatgccgcatgacatttattatggggagaaacgcggagcgcaggccagataaggcggagccgctatccggcaatctgctctgcctgaagtggaaattatccggatggatagactcaaggccagggaacgctttgagactaacgccaggatagaacaggccgcggcaggcagttccataccgcggcccggcttcagaggaggctgaaaaggattatcgcggcaaaaatagcagcaataacgagatatttcagcgcgtaatagagagtgcggtttttctttttcagacgttgcccggcatcgcgtgctgcgtgaacgtatttaaagatgcgattaatcgcaccggtgcgatcgttctcgtcgtttggcgaactggcggcggacatcaacgatgcgccgacccagtggtttacgctctgcgcccagcgccatttcattgggcgctcaatatcgcaaaagaggataatacgcgtctgctcagttttattttccgcccaatgaacgtaggtttcgtcgaagatgacggctttgccgtcgcgccagctatggcgctgtcgatcaacttcaataaaacagcggtcgtcattcggtgtgcttaatccaagatggtaacgtactgaaccggcataggggtcgcgatgttttcccagataggccccgggaggcaactcggcgaacatcgccgctttaatagaggggatgctgttgaccagctttgtcgttatcgggcataacgtttccgccgacgggtgggcatcggaataccatttaaggtaaaaccgtttccagccgcgcttgaaaaaggtattgaatccggcgtcgttattggcctgcgcggcttttatgtgatgctgaagctgtagtgcctcttcacgaatcacctgccagttttccgtcagcttctgcagctctggaaatgccgtggtatcaaagtacggctgctttgccggtaacgttgagaagcgagtcatgaacatattgatcggcgccataaacgtcgagtggtcaaagagctgacgggaaagtttttgtttttccaccccgcgtgaatgcgcataaatgacgctgataataaaaataccgataatgattgctgcgaacataacgtcactgtccttctaagaaaacctcatcccgggattttcaggcaaccctcccggtgatgccaaagagaaaagtgtagttcgttgacaataaatttacatttctacaacttaaaagggccatttttgctaaagaagcgagtcagcccgtttaacctttatccaggcttgtcgacagtagaattgagatgactccgctacttcacccggtgatggctgattacgttatgccttatctcccgatgacggctgccagatcacaatgctttcgtaaaccgaaaatgactttgcttgtaaccttcgcgaagataaaaacggtgtgcatcgcggcgtttaatatttgtggaaagctccgttagctcggcgcccgcctgacgtgcttcttcttctgcccaggccagaagctgactgccaattttttgtccccgcatcggcggtaataccaccagctcctgaatttcgccaatccagttggcatgatggagatgaaactgcatatgcaggctgatcatgccgaccacctctccgttgcgcagcgctaaacgataatgaacgttggggtccagtaaattagcggcgaatccatccctgaaagcctgataatcaagctcatttttaagtaactcacagataagcgcgtaaacagaatcggtatcctctgttgtcgcgtggcgtaattcacagactggcataacgtcctcccgacgcctcatcaggatcaaccatctttcgccagactgtagcaaactaccgtcattatttattctatgacagttaaacggcggataacgtgcagccaaagatcactctgatggcaagggggagggcgagcctcccggggagttaggtggcaggctgatgtttaaccacgttaatcatccacggcacaccgaaacgatcgctgaccttgccgaaaccctgcgcccagaaggtctcctgccagtccatttcgatttgcccttgtgcggcaaggttatcaaaccagcgcttcccttctgctacatcctgggtatcaagcaccagcgtaaagccggaataatgcgcccttcccgacgcgctggcatcactcatcatgatatcgctgccggcaatgcgcatgttggcgtgggcgatagctgtatcgggaaagcgcattcctgacgggcaaccctcttcgttatccgccgccgaggggggcatttcaccgaagctgagtttataaagcagttctgcgcctaacgtttgttgataatacgcgatggcgtcggcacagttgccggcaaaagagagatagggacttaacggcatgatggttacctcaggtaagagatgctcgttaagtgtagttcgaaattggcacaatattgtcggtggcagggccgctcaggcccggtaagcaaggcgctaccgggcaatgacacggtaaatcagttctttttcacgaactcggatttcagtttcatcgggccaaaaccatcgattttgcagtcgatgttatggtcgccttcaaccagacgaatgttcttcactttggtgccgattttcagcatggaagagctaccttttactttcagatctttcacgatggtgacgctatcgccgtccgccagcaggttgccgttggcgtctttgacaatcagctcatcgctctcctgagcgggttccgcatcgttccattcgtgagcgcattccgggcagatgaacatgccgttatcttcgtaggtatattcggagttacattgcgggcagtggggtaatgacatgttggtatcctcaaaaagtcagcgggggcaaacgcgcccaaaaatggcagatcgccgaaaaaggccgcaattatacacaaaatccttagcgttgtcgggactattgccgcttttataaaagggtctgcgccacgccagtcagcaatggtttacactcgaataaccgcttttttactgtcaccacagcgcattagggcgtccttatttacaccttttgaccgaattgacatatatgtgtgaagttgatcacatatttaaaccctgttagggtaaaaaggtcattaactgcccattcaggcgtcaacaggttcggttgtacagtccgtaaccggacagtgtaagtaaacctgctacgcttgtatgagggatagcgttcgcgcccctccctccgctcgacggcgacgctggcgcggtatgccagtgcccgccgtatatagcgctacagggcttagcctatgaggacagctatgctgaaaaggaaaaaaataaaaccgattacactgggcgatgtgaccatcattgatgatggtaaacttcgcaaagcgattaccgccgcctcgctgggcaacgcgatggagtggtttgattttggtgtttatggatttgttgcctacgcgttgggtaaagtctttttccccggcgccgatcccagcgtccagatgattgccgcgctggccacgttttccgttcccttcctgattcgtccgctcggcgggttattctttggtatgctcggcgataaatacgggcgccagaagatcctggcgatcacgattgtgattatgtcgatcagtaccttctgtatcgggttaatcccctcttacgcgacgatcggtatctgggcgccaatactgttgttgctgtgtaaaatggcgcagggcttctcggttggcggggaatataccggcgcgtcgatctttgtcgcggaatattcgccggatcgtaaacgcggatttatgggaagctggctggattttggttctatcgccggattcgtgctgggcgcgggcgtggtggtcttgatctcgacgattgtcggcgaggagaatttccttgagtggggctggcgtattccgttctttatcgccctgccattggggattattggtctctacttacgccatgcgctggaggagacgccagcgtttcagcagcacgtggataaactggagcagggcgaccgcgaagggttgcaggatgggccgaaagtctcctttaaagagattgccaccaaacactggcgtagcctgttgtcatgtatcggtctggtgattgccaccaacgtgacctactacatgctgctcacctacatgccgagctacctgtcgcataacctgcactattctgaagatcacggcgtgttgattatcatcgccattatgatcgggatgctgtttgtgcagccggtgatggggctgctgagcgaccgtttcggtcgacgtccatttgtgattatgggcagcattgcgctgttcgcgctggcgatcccggccttcatcctgattaacagtaacgttattggcctgatttttgcaggtttgttgatgctggcggtgattctgaactgctttaccggggtgatggcctcgacattgccggcgatgtttccgacgcatattcgttatagcgcgctggcggcggcttttaatatctctgtattgattgccggtctgacgccaacgctggcggcctggctggtggaaagctcgcaggatctgatgatgccggcgtattatttgatggtcatcgcggtgataggcttgattaccggtatttccatgaaagagacggccaatcgtccgttaaaaggcgcaacgccagcggcgtcggacatccaggaagcgaaggaaattctgggcgagcattacgataatattgagcagaaaatcgacgacatcgatcaggaaattgcggagctgcaggtcaaacgttcgcgtctggtacagcaacatccgcgtatcgatgaataaatttcgcgcttaaggttcgcttaatctctcgcgggcatactctcctccatacctttggaggagagcgtcatgaaaagctatatttataaaagtttgacgaccctgtgtagtgtgctgattgtcagcagttttatctatgtgtgggtcacgacgtattaaacgcctgttatgcctttttcaacagcacccaggcacgggtgcctgttctttccgtacggttttgcaggaaaaactgtccctgatgtagttgggtgatgcggctgacgatactcagccccaggccaattccgccataacggctgtccatccgcacgaacgcttcgcttagcttcccgcatttgctttcatcaatacccggcccctcgtcttcgaccgccataatagcgtcggggtcggcgctaatgtggatagtgatatgggttccttcagggctatagcgatgcgcgttttccaccagatttcgcaacagcatacgcagtaacgtcgcatcaccgcgcaccaccacgtccgccgcgctttccggcagcaacagagtttgctggcgcgtttccagcatggtgttcagctcatcgtaggaggggaggatcacatcttccagcagttttacttcctgataattcccggaagagaatgactggcccacgcgcgccagttgcagaagctgggagacgctatccatcatctggtcaagacgggcgataagcggcgcgacatcaacattgtgggtttttgacaataattccaggtgcaaacgcacccccgacagcggcgtgcgtagctcatgggccacatcggcggtaaaaaggcgttcattgtcgagcgtggtggtcaaacgcgtaaccagttgattgatcgccgagacgacggactcaatctcaagcgtggagctgtgaatggcgatcggcgccagattatccgccgtccgcgcttccagctctttttgcagttcggcgagcggacgggtaatacgccgtaccgcctggtaacaaattagcagcgtcaggctaaccataaatacgccggggacgatcaggctggcgaccgcctcgcgaatttcgtgcatgatatggcgatcgttgttgcgattatcccgcagcgcctgctcgaacaattggatttgctcagtgctttcatgccataaccagaaggtactgattaactggaacaccagcagaataagaccaattgtcagcattaaacgctggcgaagggtcatcgctcttcgctgaaaacgcatcaggctcacttagctttcctcagtggcaaccagcatgtagccaaacccgcgaaccgtgcgaatgcgcgacttgccgactttgtcgcgcaaattatgtatatgcacttccagagtgttggtcgagggttcgttatcccagttgtagatatcgttataaagaatttcccggtgcaccggactgcctgccttgagcatcaaccgtgagagcaacgcgtactccttaggcgtcagggtcagttcctgtccatccctccatgcctgatggcggcctatattgagcgtcagattgccaaccgtcagttcactttcaccctggttattatggcggcgcagcagcgcgcggatgcgggcgtgcagctcctccagggcgaagggtttaaccagataatcatctgcgccgacatccagcccggtaatgcggtcattgagcgtatcgcgggcggtcagaatgagtaccggcagggtatattttttctgtcggattcgcgtcaggaaatgcaggccatcctcatcgggcagccctaaatccagcaccatcagactgtaatgaccagactccagactatgctcggcggcacgcgctgtcgaaacgccatcacacgcatagccttcggtttgcgcggcgagtattaacccctgtaataatagcgtgtcgtcttcaacaatcagtatcttcattcgcttagtctcctgcacggttgcagaatatcatctgcggcctggtaatacgtcgtttgtacgccggttaatcccagcatggttgagaaaagattgtcctgtgaataatccagcgtgctcgcccgtttttgcaggcaggcctgatccacctgataacgctgttgataatctttagaaagccaaatgagcatcgggacatgtttttgcgtatccggcgcaatggaatacggcaaaccgtgtaaataaacgccattttcacccaatgattcgccgtgatcggaaagatagaccaggctggtggtgaatttatcctgatgagatttcagcaggttaatggctttatctacaatatagtccacgtacagcacggtattatcataggtgttgatcaactgctcttgggaacagttctgaatttcgttagtgtcacaggttggggtaaattttttaaactgcggtggataacggttgtaataggttgggccgtggctgccgatggtatgtaatacaataacgccatcgcctttcaaatggtcgatatagtcttccagaccgtgaaataacacttcatcgtagcactcgccgtcgatacattgtccgggcaggtttagctcggtgacattttgatgcggaacgcgatcgcatgcgcctttacagccgccgtcattatcattccacagtacgttaatccccgcgcgctggataatatccagcagcccttcctggtgatgcgccagctcttcgtcataatgtttgcgcggcatatcagaaaacatgcagggaacggagatcgcggtcgccgtaccgcaagaggtggtatgcgggaagtagatcacatcgtctttcgccagccgcggattggtgtcgcgcggatagccgccaagagagaaatcatcgccgcgcgaggtttcgccaacgatgagaatcgtcaggtttttgcgatcgcctttcagcattaatggattgcgatgggcatcctcgccaatgcgtaccagcggcaaattcgccagccgttgatgtgaataccatgaccaactggcgacaatactgttcgatgggcttaatgctttgatcaactgtttattatttcgaaataacgaggcgtaatctttatagaaaaaggcggcgaccagaataactaataaaatagagatcaggacgctggccaggcggtaaagcccgctacgtaagcgcggcgtcgccggacggattttgacccagaaggcaatcacggctgccagaacgccgcttaatcccagcgtcagcaccatttgcggcgtcatcagcgcaaaggtttccgcgggcgtggtatccatcatattggcgatcatggagcgatcgatgatgatgccgtaagtcaaaataaaatactgcgcggcagcgccgaccagaataaaaacgcaggccagcagtcggtttagccaaataaatgaggccagcgtcagcacactattgaccacgctaaacgcgacgaccggcatggaaataaacaccagcacattgcgcagcgagtttaacggtaggtcttgtagtacctgcttgtagaacgcaatgttcaggcagacggcaatataaaaggaaaaaagcagaagccaggcgatttgcccaagaacaggtcttttaagaaagcgctttaacatgttgatgcgtccatcgattcggtgacgctaatcgtgacaaagtaaaattaagtgaaccttaagaacttaatgttggtggcggccggataacctgcgctatccggcctgttgcgataacattaactacacgtggtcaatcctgtttaaccggcgcatccagcggatacgggtttttgtgaatgcggttgtagttcaacgcatacagcgcggtgatcaccatcaacgtgacgaacgaccacatcacttctttggcgccggaaccgatgaccgcccagatgcaatacacaaacgcgacgaaggtaatcagcagatacagcgggcgcgctttaccaaagtgaccgtggcccaacagtaacagcgcggcacaggtgtaaagataaggcaccagggtgaagataaccgacacggaggagaccagaccaaactctttcgcggcgttcggcgacatactgctgaactggaagatagtcatcagcacgccgacgataagcaacccagccactggcgtaccggctttattaacccgtgcgaagattggcgggaagagaccatcgtccgccgccgcttttgcggtttgaccggcaagcagcgtccagccgccgagagagcccaggcaacctgctgccgcacagaaggaaacaatagcccctgcggtatcgcccagcgccatacgcgccgcgtcaccgaaaggcgatgccgacacgcgcagcgccgcgttggggatcatccccataatcgccgttgtggagagcacatagcagacggcggcgatcagtaccccgccgatggtggcgataggcacattgcgtttcgggtttttgaccacaccggccgcaacggaggcactttctaccccgatgaatgaccacagcgtaacgttcaacgtgctttgaatcgcgccgaaggtattcatgccgctcacgttccaggccgccatataggtttcgcctttaaaccagaaccagccgaagaccgcaatccctacgataggcaccagcgccagtacggtggcgacggcctgtacgcgggtaatcattttcggcccgacgatgttcagcagcacaaaaatccacagcaccgcgacgcaggtaagcgttaataccagtggatctttcagaattgggaagaaatagctcagatagccgacgccgataacgaccatcgcgatattaccgatccagcatgccagccagtacagcacgttcgtttgatagcccaaaaacggcccgaagcagcggcgtgcgtaggcataggaaccgccgggactgggatctaaggacgacattttggcataaaccatcgacagcgccagggcgccgatgatagtgaccagccatccgtagattgcaatcccgccagtggccgccaggttagcagggagtaagaatacccctgaacccataatattccccgataccattaaggtgacggggattaggcccactttgtgagcatcagcatccgaagacataatttggactcctgaaaaggtgacttcgttacgataaattacgtcgtatcataccccctcagaatgccgctgaattatgtcggagacgggttatcgccaatgctgctattatcgtgtcttatcgttgagtgtagaaaaattaggcagccgatcgttcccgatgttggctaacataatgcaggggggtcataccataaaactctttaaacacggaaataaagtacgatgtgctgttatacccacacagctgtgagacttgagagatattctttccgtccattaataattggtttacggcataacgcattcggcaggtcgtgattatttggctataactggtattctcgtttttgagctttttctttaacaagcttggactcaggcacaggcaactggcaacggcgctcagattccagtctttatgaatatcgctctgaatgatgtggtaaacgctgtcactgatgcggctgcgcagcatgtgcattaacaaagaaataaattttttgtggtcaagaaagcgggataaaacggtgaaaaggagcgcacgggtacgttcactaacaatttcatccggtgcttccatcgcgctgtagcgggcggcgaccctgaagatatccggcgtcagacagttggcggtcaataagggatcggcgttgcgttgccagacgggaaggtgtgagagatctttattcaggaattgtaaatagtctttaatattattgcgactcacttgtattactagcacgctatttaatgatgaaatgtcaataacgttattttcacaagccagaatggccatatgattcgcttttaagctgattggctccttaccatttactcgtaaccatgtatctttttcggttaataacactatgcaaggttcgttgctgcaaatcctcatacccgaactcctggaatatgaacataaaagaccggatctcgccaaacgggagagataacggggactgagtcaattgtgtgatgaattgaaactgcactaaaataactttcctgaataatattacaatatttgtacgatgaattagggtgtacaaaaagttgtacgcgagtggaaacttgtcatttttgtataaaaaaagcgcgggatggggcccgcgcaaaaaggtatgacagtattattgttttgcagcaatactcagggaatacatgccatcctcaaaaaaaagactctttgtgattaggctttcacgcacataacgtgatatacgccatcaataatttccgtgccttcggtttcatgctcaaagccagggaagtgatgatcccaggattgcagtgagcgtaagtaacccacctgcggactgttttcatcgccaaagttttcgccggagagcagcatcgggatgcctggcgggtaaggaataacggagttcgccgcaatgcgacccggtagattttcaatcgccaccatttcaatattgttgttcacaatcgcgttgtaggcgtcgcgcggggtaatctccgcaaccggcagggtggaataggcggcgttgagacgggcgcccgggttattttcacgtagccaggcaaacattttatcgcccaggtcatgaatacccatgttcgcgtaagtgtcaggataatcctgcaccagttccggcatcacctgcgccagcggcgtattcgcgtcgtaatgatgtttgaaggagcacagcgtgttgatcagcgttccccatttcccgcgagttacccccatagagaacaggaacataatctgaaagtcggtggtgcgggtcggcacgataccgtggcggccaagccatgctgtgaccagcgcagcaggtacgccggatgcttccagttcgccatcgtcgcccatacccggcgccaggatactgactttaatcgggtccagcatactccagttatccggcaggtctttaaagccgtgccaggtttccccggggcgcatgacccagcagttctggtcagtggctagcagttttgccggcgcgtcggcgaagtcatacgttttaccggtttgtggatcggtgacgacgtccttattccacggtttaaagaaccagtcgccttcatcggtaaactctttataaagacgcgccatcgcctgacggaaatcaaccgcttcgtcaatcacctcttgagtcagggacaggccgctgttaccgtccatcatcgataccgccacatcgttggatgcgcagatggcatataacggagaggtggtggcatgcatcatataggcctggttgaagcgggagaaattcaccgcgccacggccttcacggacgtgaatgtaggaagcttgtgaaagcgcattcagtagtttgtgcgtggagtgggtggcaaacacggtcggaccgttatggtcgcctggctcgccgcgcatcgcgtagtgatcgcaataaatcgggttgaagcgcgcatagccgtaccatgcttcgtcgaagtgaatgcgatcgctggtttttgccagcagatcctgcgcctctttggcgttatagcatacgccgtcataggtacagttggtcactacgctgtaagacggtttctgtccggctttagttttggtcagcgggctggcgctgatttttttctgcaaggtttcaggctgcatttcctgcgggtagattggcccaataatgccgtaacggttacggcttggcaccatatataccggtttggccccagtgaggatcagcccctgctcgatggatttatggcagttacgatccagtacaacgacatcattatccgtcatacaggcctgcataatagtacggttagaacctgaggtcccgacaactacggaccaggagcggtcagcaccgaatacgcgggcggcgtttttctcgctttcgccaaacgcgccggtatggtcgaggagtgaaccgagcgtggtacgctcaatccccatatcgctgcggaacaggttttcgccataataatcgtgataaaagcgaccggaaggcgttttagtgaaaccgacgccgccctggtgtcccggcgccgcccatgaatattcatgaatgtcgctgtatttcatcaacgcgttaaacagcggcggtaacagttgctggcgataccgggtcatggcggcaacggcgcgtccggcgataaagtcagcggtgtcttccagaatccaggcgaattcatcgacaagctccagcaggtcgcggtccagcgatgccgtcgctttttccctgtcgcctaacaggaaaacgggcacgttttgctgacgctcgtgaagcttaccgatcaattgcctgacgctcaggtgctcatccggttgttccatttggtagctaaacatcagacagtcaatggcttcgttcgcggacaagatggcatagccgtcatcgaaggatgtcgatttaatgacggtaacattttgttggctcaaggcatctgccagacgctcaaccgcgttgccaacccaggtgtcctgatgcagaaactcactttcaacaattaatactttcatcatcttttacccggttgtggaggccgtgcaatttacgccttgccgacccgccgtatgaatgtgacgtgggcaagtattaccccgtcaaatagggggtgtaaagtgatggaataatggtcggttattgatattattgtttaataaacaatgggttaattattgatattgagcgatttcacctgccgtttatcgacaggtgaattatttttttggctgatagtggtatccggctttagccgggcatcgtctggcgtcgttgctgacttagcttgcggtattgttgcggcgacataccgacaaatttgctaaaagtactgtaaaaacggctgctggatcggaacccggcagtcagagcgacatcgaggatcgttttgtcagtatcgctcaataaggcacgtacgtgattgatgcgcatcgccgtgatgtactgcttcatcgtcaattgcataacccgctggaatattcccatcgcgtaattagcattgagtttgacatgctccgcgacgtcgttaatggtgagcgcctgatcgtagttatcggcaataaatcccagcatctggcttacgtaaaactgcgcatggcgtgagacgctattcttgtgggtgcgtgatgttttattgagcaaaatgggttgccagccggaaaggctaaagcgtttaagcatcaggccgatttcatcgatcgccaactggcgaatttgctcattcgggctgcttgtttcctgctgccagcgcaacacttcaaaggtgctaagctgctgggtcgccagtgatttaaccaccatcccgtgcgtgacgtggttgataagatcgcgatccagcggccaggagagaaacaggtgcatcggcaaactgaaaatcgccatctggcggcagttgccggggcgggtaagctggtgtggcgtacaggcccaaaacagggtgatatgcccctgctttatctgcacgacttcattgttgattaaatactccacatcgccgtcaaacggaacattcacttctacttgcccatgccagtgactgctggccattctgtgcggcggcctcagttcaacgtccagtcgttgatattcggaatagagcgacagcgggctacgggtttgcttttcatcgccgttgcacatgtgcgggtcgggcgggaggagggatattgcttgcgtactcatcgtcactccatttcctgaattatcagaattatgcccctttagccgggaggaaaccgggaatccggacacagaatccgtcgatattgtagagcgtagcctgactatcaggccgaatactctgctttttacgccattttgtcccaaaaactcagatctcccgcgcgccagcatacgatctgagttttcgggaatgctcatcggggaagacggaggttttcaccgggaacgcgtgccaccatgaaggtgttcactactgttctggagagtcatgatgacggcacccaaaattacctttatcggcgcaggttctacgattttcgtcaaaaatatcctcggcgatgtgtttcaccgcgaggcgctaaagtcagcgcatgtcgccctgatggatattgacgaaacccggctggaagagtcgcacattgtggtacggaaactgatggactcagcgggcgcttctggccggattacctgccataccaaccagaaagcggcgctacaggatgcggatttcgtggtggtcgcctttcagattggcggctatgaaccctgcaccgtgaccgattttgaggtttgtaagcgtcatggcctggaacagacgatcgccgatacgctggggccgggcggcatcatgcgcgcgctgcggaccatcccgcatctgtggcggatttgcgaagacatgacggaagtctgtccgaaggccaccatgctcaattacgtcaacccgatggcgatgaatacctgggcgatgtatgcccgttatccgcatatcaaacaggtcggcctgtgccattcggtacagggaacggcggaagaactggcgcgcgacctgaatatcgatcccacctcgctgcgctaccgctgcgccggcattaaccacatggcgttttacctcgaactggagcgcaaaacggctgacgggacttatgtcaatctctatcctgaattgctggcggcctatgacgccggacaggcgccgaagcccaatattcacggcaatgaacgctgccagaacatcgtgcgctatgagatgttcaaaaagttgggctacttcgtcactgagtcatcagagcattttgccgagtacacgccgtggtttattaaaccgggacgcgaggatctgattgcgcgctacaaggtgccgctggatgaatatccgaaacgctgcgtagaacaactggcgaactggcataaagagctggaggagtataaaaccgccgagcgtatcgacatcaaaccgtcccgcgagtacgccagcaccattatgaacgctctgtggaccggcgagccgagcgtgatttacggcaatgtgcgtaacgaggggctgattgataacctgccgcagggaagctgcgtggaagtggcttgtctggtggatgccaacggcattcaaccgacgaaggtggggacgatcccttcccatctggcggcgatgatgcagaccaacatcaacgtgcaaacgctgttgaccgaagccatcctcacggaaaaccgcgatcgcgtgtatcacgcggcgatgatggaccctcataccgcagcggtgctgggtatcgaagaaatctatgcgttggttgacgatctgatcgccgcgcatggcgactggcttccggcctggttacgccgttaatctccagccgcgctggacggcagatccggcgtttaacctctactaacagaaggcgggcgctggtaacagcgacccggtaccctatgagcatctctctgacaacaaagctgagttacgggttcggtgcgtttggtaaggatttcgccatcggcattgtgtatatgtacctgatgtattactacaccgatgtggtgggactttcggtcggcctcgtcggcaccctctttctggtcgcgcgaatctgggatgcgataaacgatcccatcatgggctggattgtcaacgccacgcgttcgcggtgggggaaatttaagccgtggatattgatcggcaccttaaccaattcgctggtgcttttcctgctgttcagcgcccatctttttgagggaaccgcgcaggttgtatttgtctgcgtaacctacatcctgtggggcatgacgtataccattatggatatcccattttggtcgctggtaccgactattacgcttgataagcgagaacgcgaacaactggtgccgttcccgcgtttcttcgccagtctggctggcttcgtcactgccggtataacgctgccgtttgtgagctatgttggcggggcggatcgtgggttcggctttcagatgtttacgctggtactgattgcgttctttatcgcctcgactatcgtgacattacgcaacgtacatgaggtgtactcctccgacaacggtgtaacggcaggccgcccacatctgacgttaaaaacgatcgttggattgatatacaaaaacgatcagctctcttgcctgttgggaatggcgctggcgtataacattgcctccaatattatcaatggctttgcgatctactacttcacctatgtgattggcgatgccgatctttttccctattacctttcttacgccggcgcggcgaatctgctgacgctgattgtcttcccccggctggtgaaaatgttatcgcggcggatattgtgggcgggcgcctccgtgatgcccgttctgagttgcgcagggctcttcgcgatggcgttggcggatatccataatgccgctttaatcgtggcggcgggtattttcctgaatatcgggaccgcgctcttttgggtgcttcaggtgatcatggtggcggatacggtcgattatggggaatttaagctcaatattcgctgcgagagtatcgcttattccgtacagacgatggttgtgaagggcggctcggcgtttgcggcgttctttatcgctctggtgctggggctgattggctacacgccgaacgtggcgcagtctgcgcaaaccctgcaggggatgcagtttattatgattgtcctgccggtactgtttttcatgatgacgttggttctctacttccgctactaccgtttgaacggcgatatgctgcgcaagattcagatccacctgctggataaataccggaaaacgccgccattcgtcgaacagccggatagcccggcgatttctgtggtagcgaccagcgatgtaaaagcgtgagcatggtctctcgtgcaggccggataagccggataagcgtagcgccatccggcaattaaccgataacgcggcccgggagaacgccgggcctgccaggttatttcgcgcagttagcgcactgtttgctgacaatctgctggaagaaatcgttgcctttgtcatccaccaggataaaggccgggaaatcttctacttcaattttccagatagcttccatgccgagttccggatactcgacgcactccagatgcttaatgctctgctgtgccagtaccgccgccgggccgccgatactgcccaaataaaagccgccatgttttttacaggcatccgtgacctgctgactacggttgcctttcgccagcatgatcatactgccgccgtgggattgcagcagatcgacataagagtccattcggcctgcggtggtggggcctaatgagccagatggataacctgccggggtttttgccggacctgcgtaatagatgggatggtctttaatatactgcggcaggtcttcgccggattcaatacgctcttttagcttcgcgtgggcgatatcgcgacctacgataatggtgcccgtcagcgacagacgagtcgagaccgggtactgcgatagctgggcgaggatctctttcatcggacggttgagatcgactttcaccgcgtcgccttcgcccgcctgacgcagcgctggcggaatatactggcccggattgtgttccagtttttcgatccagatgccttcgcggttgattttcgctttgatgttacggtcggccgagcaggagacgcccatccccaccggacaggaagcgccgtgacgcggcaggcgaattacgcgaatatcgtgggcgaaatatttcccgccgaactgggcgccgaggccaagtttttgcgcttcttccaacagttcctgttccaggtggggatcgcggaatgcctggccgtgctcgttaccttccgccggcagcgcgtcgtaatagtgggtgctggcgagcttaacggttttcagcgtgctttccgccgaggtgccgccaatgacaaaggcgatatggtatggcggacaggccgcggtgcccagcgtgcgcattttctcaacgaggaagtttttcagcttgcctggggtgagcagcgctttggtctcctgatagagatacgttttgtttgctgaaccgccgcctttcgccacgcaaaggaacttgtactcgtcgccatcgacggcatagagatcgatttgcgctggcaggttgctgccggtattgacctctttgtacatattcagcggcgcgttctgcgagtagcgcaggttatcttcgatataggtattaaacacgcctttggagagcgcggcttcatcaccgccgcccgtccagacgcgttggccttttttacccatgataatcgccgtgccggtatcctggcaggtcggcagaatgcctttggcggcgatctcggagtttctcaggaattgcaacgccacatatttgtcgttttcgctggcttcggggtcatggagaatggcggcgacttgctgctggtgttcaggacggagcataaaagacgcatcatggaaggcctgttgagccagcaacgttaacgcctgcggctcaacgttgaggatagattctccattgaattcactgacgctgacataatcggaggtgagcagataatactctgttttgtcctctcccatcgggaaaggcgcctgatagataaactcttttttcgacatgtgcttccagcctaatagtaagaaaatgtattaagaacctcatgggccaggctctaagtcgcgcgccgcgcataaccgggcggcgcgcgcggccattacaggaatccgtacattgcggcaaagatccagccaaagacgcaggagacgctcacgccaatcaaacccggcagaatgaagctgtggttaatgacgaagcggccaatacgggttgtgccggaacggtcaaactgaatcgccgccagatcgcttgggtaggtcggcaggatatagtagccataacatgccggcgcagaggccacgatatacgccggatcgacaccgatagccagcgcgacgggaacaatcgccgccagcgccgctgcctgggagttaacaaacttggagaccagcagcagaacgatggcgtaggcccacggatactctttgaccatttcgcccagcacgccctgaatttccgacatatgcgcgccgaacatggtttccgccatccaggcgatcccgtataccgcgacaatcgcaatcataccggaacgaaaaacttcgttttttgagatagacgcaggattggttttggtcaggatgataatgagcgccccggtcagcagcataaacatctgaatgaccagcaccatcgacaacggtttgccgccgaaggttggacgtaagtcggagtccgcgcccaggagagcgaccacggcaatcgccgccaggaagatccacatcgccagccagttgcttttcggcagttttttatccagcagcgtcgcggtatcgccgtacacgtactgacggttttccggtacggaaataaatttctgaaacgcttcgtctttatccagatctttaccgcggaaccaactaaaaataccgattgccaggataccgagcagggtagacgggatggtgatcgacagcagatcgaggaactccagatgttttccgtcaaatgtcacgttgcccagcatcgctaccagagaaaccacggcgacggaaaccggactggcgatgatgcccatttgcgcgccgatagaactggccgccattggacgttccggacggatattattcttgatcgccacgtcatagataatcggcaaaatggtgtagaccacgtggcctgtcccacacagaatcgtcagggtacaggtgacgaacggcgccacaatagagacgtatttggggttgcgacgcagcagcttttcggcaatctgcagcatcacatccagcccgcctgacgcctgcaacgtcgccgacgcggcgactaccgcgataatgaccagcattacgtcaacgggcggtttgcctggctggagatggaaaacaaacaccagaatgaccagaccgataccgcccaacaacccgagcgcgatcccgccctttcgggcaccataaaacagacatattaatattatgagaagctgtatactaaataacatttttatttatcctcgcgataaacccagtcaattttgataaatggatcacagccatcttctgatttttgtgaatgagcatcaggaaatggcgaatattcaatgcgccagtggcgacgattaacgattaagctttttacagagttgctttaagtaattattttcttgcgatggtgatgttcagaggggagtaccctctggcgatgggcaggtggagtcagcgagagcagtaaattatgatttgtctgttttaaaaacaggcgtttattatttgatttttgtgtctcgccatcaggtaaatcacgagataaatcgaacagcatgtgacttatgtgatcattgtcacgccatttttttaaattattagtatggcgtgtggagacgcgtatctgctcaccaatatacgtattgtccataggcgtagcacaagctccattgctacaaacataattttatttaagtgtcaggaaaattccggacaaatcccttttttaataaaaatacacactctcggcatgggataatacttaattaacttttgttagcgttttgaaattaaaaacagcgcagagcgctgtaataatagaaaataacgttaacaggcctggggtgagtatatttgatctgacacaatttcccaggtttgttattaatgtgatagcgtttttattggcattgttataataaatgttaccaggatataacgcttcgcgtcggctttatgcggtatccttactgacaatattgtttcagtaaagagtaatgttccggctgaacgcggtagcggtaaaccggcctgccggtcacgccgtaatgaatactggtaaacaagatatggcaatttaccagccagatgagatatttacggcaggagacgcgtgagatattcacttcgttggccaactcgtcggtagaaaattcctgctcctgatgcgcatcaatccactggcataaggtgcgtagcgtttgctgcgtcagcccttttggtagccgacgaggctcctgctcgctggatgaattaccgtgaatgagcaggtcaagctcagactgttcgtaatactggcgtttttccatcgccgttttcttacgtagccaaccggtcaacgcttcttcaaagcgcgtggcctgaaaaggcttgatcagataatccaccacgccgtagtgaagcgaatctttaatggtggcggcgtcagcggcagaagaaatgacaataacgtcgcttttgcagcctgcgctgtgcaggacaggcagcagatccaatccgttttcctgctgcatatagatatccagcaggattaggtcaatgtgattttcactgttgaagataaactctttcgctttttccagcgtcgaagcggttccacaacaatgaaaaccggagatttgcgcgacatagcggcgatttaactccgcgaccatcgcatcgtcatcgacaattaatacattgatcataggctggtcctttttccatcccagggtaactgtacaaaaaattgtgtgaagatcccaggctcggactccacggaaattacgccgccaagcgcttcaacctgctgtttaaccagcgctaaaccgacgccgcgttcggcgcctttcgacgagacgcctttttcaaaaatcgcctcgatgcgctcaggttcgatacccggaccgtcatcgctcacttcgcaatgcagccagccatgacggtagtgtaacgagacgctgatttcgccgccggattcctggctcaacgcttccagcgcgttttcaatcaaattacccagcgccgtaatcagcaccgtaacctgatcttcattgttattatccggtaactggctgtcgctgcttatcaccaggctgtgcccgaaatcagaggcgcgggtaatcttactgagcaaaaagccagcgataatcggcgactttattttacccagcagcaaaccgatctcttcctgatagttattggccgtcttgataatatacgcttcaagctgcttataactcttcaggtgcaataatcccagaatcacatgtaatttgttcatgaattcgtgggatcgttcacggagcgcatccgcgtagttcaccatcccgtccaaccgctgcatcagttggcgaacttctgttttatccctgaaggtggatatcgcgccgataatttcgccattgctgcgcaccggaacggtattcaccagcagcaggcggcctttgacgatgatctcttcatcgcggcgcggcgtaccgtcacgcaacacttcgctaatgtccaccacctgcgaccaggcatgactcagggtggataatctggcgtcatcctgcgtttttcgataatcgagcagcgcctgcgccgcatggttaatcaacgtgacttcgccgctatcatccacggcgataacgccctctttgattgactgcagcatcgcctggcgttgttcaaacagggttgagatctcatagggttcgaggccaaacaggatacgtttcagcaccttgaccagcgcatacgtgcctaataaccccaccagagcgccgaacagaatggaccagataatactgccgcggctattgttgatctgctgcgtaacgtgactgagttccaggccaatcgctaccacgccgatctgccggtggtgttcatcataaaccggtgtgaaaacgcgcagcgctttggcaagaaagccgcgattaatggcaacgttttcctttccctgcagcgcgagcagaatgtcatcgcctttgaacggttggccgattcgctgcgtttctgggtgcgaataacggatgccctgcatgttggtcaccacaataaacaaaaagccattatgctggctcaccgcttcggcgagcgtctgaatgccgctttccgcaggcggttttttcagcccctcgcgaactgccggagagtccgccagcgagcgagccaccgccagcgctttatctgccagcgcgtcgcgcgtcatgctgctgatttgcgaaaaatagatcagatggaccacaacgagcaccgaaaacaaaacggcgctgaccatcagaatgacggtagtgccgagtttcatggggcgtttgcgtaacgcccggcatggcagggagtgtttcatagtggacctgagcggacgaatcgtaaggttattatccctgatgaggcgtctaattcaaaggcataggcgatgttgctccagtgttgaaaagcccgtcttgccttgcagggcgcgctacctgctcatgtcgttaattaatatcgccggataccgtgatgggtaatttattttcatcagaattacataaaataatttttcattaatttttataataacgtatgcggtatcacattttatttttactgacgttcagaatgcgtttgatcacaatcaatcagcgctaatatttaatctattatgattagttttcattacatattattaataattatggaagcaatgtgagaaataaaaaatggaaataaaaaaatggctgaacacaaccataacccgacgtgatgctattgtcgctactgcaaaagtaggggcggcggtgacgctaagccaggcgattacgctgccttttgctaccactgcccaggcgcaggataccccgataccgaaggatgccaacggcgaaaccgtcaggcacagcgcctgtctggtcaactgtggcagtcgatgcccgcttaaggttatcgtgaaaaatgatcgcattgtgcgtattgagccggaagacgcgaaagatgacgcggtattcggcgagcatcagattcgtccctgcctgcgcgggcgttccagtcgctggcgggtctatagcccggatcgcattaagtatccgatgaaaagagtgggaaaacgcggcgaaggaaaatttaaacgtatttcatgggatgaggccacggcctttattgcggcggaattaacgcgtgttagcgaaaaatatggccgggaagctatttattataattatcaatccggcgcgtattatcacacgcagggtagacccgcctggataagattactaaatctcaccggcggttatttaaattatcacaacacctattccacggcgcaaatcgccaccgccacgccttatacccacggtgattatgtcggtagccattttacgcagatcgcgcattccgatctggtggtgctatttggcctgaatctctcagaaacgcggatgtccggcggcggccaggttgaagagctgcgccgggcgctggagacctcgaaagcccgggtcattattatcgatccgcgctataccgattcggtgattaccgaacacgccgaatggctaccgattcgcccaaccacggacgccgcgctagtcgccggcatagcgcatacgctgattaccgaacagcttctcgacgaggcgctggtaaaccgctattgcgtcggctatgaccgtagcaccttgccggacacggctgcgcctaacgccagctataaagattatgttcttggcacgggcgatgacggtatcgcgaaaaccccggaatgggcggcggatatcaccggtattccggcaacgcgtattcgccaactggcgcgcgaaatcgcctcggcgcgcgcctgctatatttgccagggctgggggccgcagcgtcatgccaacggcgaacaaaccgtgcgtgctattcagacgctgccagcgttaacaggccacttcgggcggcccggcaccaacaatggcaactggccttacggtacgccgtatggcgtgccattgttgcctgtcggtaagaatccgatcacaacctctattccttgctatctgtggacggacgccattcagcatccggagaaaatgaccgcgacgacaatgggtgtgaaaggcgcggacaggctaaaaaccggaattaagctgtttttcaaccaggccggtaatactttgcttaatcagcacggcgaaacaaaccgcacccgtcaaattctcgcggatgaatcgctgtgtgaaaccattatcgtgattgaaaaccatatgacgcccagcgcgatgtatgcggatctgctgttgccggagaccagctatcttgaggcggaagacctggtggacagctcctatgcggcgggatcgcataactacatgattgcgattcagaaaaccgttaaaccgatgtgggaagtgcgcagcacgtatgacatctgcgcggatatcgccgggcatcttggactgcgcgagcaatataccgagggccgaactcaggcgcagtgggcggagatgcactatcagcagatccgtgaaaaacgtccatacctaccggagtggagcgtggcgaaagagatgggtgtgattgaccagcgtatcgctaccgagcagcagagccttgcgtttgccgatttccgcgccgacgccgaggctaatccactctccacgccgtcgggcaaaattgaaatttactcccaggcgctggcggatctggcgcaaacgtggactttgccagaaggcgagcgaattcccgcattgccggaattttgtccggcgaaagagtcgcaccttaacaaagcattgacggcgaagtatccgttgcagttaagcggcttccataccaaagggcatacccactcgacctacagcaatgtgctgatgctgcatgaggcggtgccggatgaagtctggattaacccgattgacgccagcgctcgccaattgaagtccggcgatcgggtgcatgtattcaatgaccgcggcgtggtggagcttccctgtaaagtgacccagcgcattttacccggcgtggcggcgatgccgcagggcgcgtggacgcggcttgacggcaacggcgttgatgtcggcggctgtatcaatacgctgaccagccaccacccttcgccgctggcgaaaggcaatccgcagcataccaatctggttgaaattaaacgcgcttaaggagtgatgtacgatgaaacagtatggcttttatgttgactcctcgcgctgttcaggctgtaaaacctgccaggtaagctgcaaggataataaagatctggatgtcggtccgaaactgcgccgcgtctatgaatatggcggcggaagctgggtgaaagagggggaaagctggcatcacgacacctttacctactacctctctattgcttgtaaccattgcgatgagccggtatgtgtctccggctgtccgaccggggcgatgcataaacgcaaagaagatggtctggtcgtggtggatgacagcgtatgcgtcggctgtcgttattgtgaaatgcgctgcccctacggcgcgccgcagtttgatacgcaggcgaacgtgatgcgtaagtgcgacggttgtcttgaccgactggagaacaatctgcgccctatttgtgtggattcttgcccgcagcgagcgctggatttcggccctgtcgatgaattacgggcaaaatatggcacggagaatcaaatcgcgccgctaccttcggcgtcgttcacccatcctaacctcattattaaaccgcatccgaaagcgagacccacgggcgatacggaaggcgcaatcatgaacattcgggaggtgcgccatgcatgagttaccgctggtcttttttacggtctttacccagagcgcggtcggcgcgtttattctgctgctgattggcggcgcaatggggctggtcgcgccgcggcgtaaggctatcggtctgttctcggtgatgtgcctgtttgggctgggcgtcattgtcggcaccttccacgtcgggcaaccgctgcgtgcgctgaatatgctgctgcgcgtcggacattcgccgatgagtaacgagattgtcctgtcggcggcttttgcggcgctcggcgggctgggggcgctcggtttgttgctgaaccgggcgacgccgctgtgtaacgcgttggtctggttggcggcgatagtcggagtagtcttcttatacgccgttccgcagatttaccaactgccgacggtggcgacctggcgttcatcttacaccacggcaatgatgatattgacgccgttgattggcggcggcgcgttggcggcattgtttggcgtgcgccgtctggggctactggtcagcgtgttggcgattttggtgagcttttgtctgcgcccgggctatatggcgacgctgatgagcgccgatagcgctctgaccgccgcgcagcatagctggtttaccgcccaggcgatattgctggcggcgggcgtggtcggggtggtggtctgcgcgcgcctgaaatcgagcgctgcggtgctggccatgacggctgtggtggttatcgcggcggagttggcgggtaggattgcgttttacaatctgtggacgctgccaatgtagttttttgcccggtttatgccatgtaagcctgatcagcgtagcgtcatcaggcgaaatatttcaggagctattgctatgctttcccgtgctgttttgccgcgtatcctcggcgcactgttttactactcccctgagaggccggaggtgaaagcgttgttcgattgtttgccaacgttgcctgagctttacccctggcgcgatcgtggatctattgaatcactgtgtgcgtcatggtcgctaccggatgatgatgcgcttacatggcaattttccgtattgtttgaaggccagggaaagatgcccgtcccgccctggggatcggtctatctggaaaaagataatttgctgatgggggaaaccaccgccgattatcgagcttttttacagtcgcagggcatggtattcactgaccgtgaacgcgagccggaagatcagtttggcctgatgctattggcctgtagcgatctgctggcacgaggcgacaacgtggcggccaaccggttactggaggcgcatctgctgccctggggattccgctatctggaattgctgcaacgcaataccgttagcgccttctatgcccggcttgccgtcgtagcgacctgttatctgcaggatgttcagcagcaacagggactacagcctgagaataagcggttgtttttctgaggtattggtcgggttttgatggcgtgccgtaatacttgtgccgccatcgtgcccgctgttgcgtcagcgggcacagtttactattacagctccggcgtctttttgaaaccggtcagcatcagcaccaggctctgttttgagtccgctggcgtgaagtcgtagtgatttccctgacggtcgccgccgatataccaggatatttccgttttcccttccgccagcgctttgcgcaccgctttatcgacatcaaccatgcgatactcatgtgaatggtccagatataacacggcatcggaacggtagttgatcgccggtttattgttccaggacacggtactgacgtgccagtcactgctggtcgggtaaaagaaaatttgatcggcgccgttcgcttccgttttgccgccaaaaaggcgaatacggtatttgaatagcgaagcgtccatattggcaggcaggggcgggatcttaaatttcaccagcgtgagcgtttccgggtgctgcgtgcgtccgccatttgtccagtcatcctgtacgtacaaggtatcgacgctggcatgaggcttgtcgtcttcgctgcttacccaggtattttcttccgctttactgtaggcgtaaggaaccgtagtgccgcaatccagtccctggttcatacacagatccgtcataaactgcgcgccatcttccgtccagccattcataaaatcggcatgggcggtataaagacttccccagcgctcttcccgggtttcgccatgcattaccgggtccatcgacaattccactttggacgtatccagcgaggagatctgcgggagtacccaggcgatgttcatattcaccgttgggattttgaccggatagtctgcggaacatttcccgtggtcggcatagatagcgttattgtggctatgggttggtttcaggttgacgccatcccaacagttggggaaagcgatcccgatattaaactggacggcatcgcccgctttacgcaggccgcatatttcgcctaccttgttggtgtaacctttgccgttggcacataaaaaggtgattgcggaactggggccagtaccgtgatgatcgcctgccagtaactccagcccggccgggaatggatggagcggatattgcgctacatttgtggattgataataggtcttttggtaggccggatttacgatttcaccatcaggtaatttcatggacggcgcccagtaagcggagctgtcggctttattatcacaggtggtatcgggttgcgcgcgcaacgtctggtaggtagagaccgcatcggtgtgggtgttgccaaaaaagtcatgccacatcgcctgattcgctttaccaaacatcataatcgcgtcatcgcccagcgtgtggtgatagccgcacacgacatgcgcctgaggaccggcatgggccgggaatgcgccagcggcaacgagcgtagccaggctgacggtaataaggttgagtttcatttttttgctgcccggttgaatagaagtgggagcagcaatagcagatcaaattgcggtgttacatctcattaattatcactttttgtcatttgccctgcatacaggggcgaatttgcagacgtactatttaaataattagccgaaactaccctcctcttgattatgtcaatttacaaaaagggtacgttagtgattaaaatcgggctttttgtgataaccctcactatttcattttgcctatgctaatggcgctcgccataaccgaataacgattctatcggacatcggctttatttttaagaaatgcgttacgacatcagtcgtgacgcgatctgctatggattttttatgagattactaaaacgcgttattgtggttgtactcttgggcgtgattttatttatggtcagggacgatatacgctatgtttatcaactgatcctcaaatatggtgataaaccctcggcgctggcactgagtagctataaagcggttattcagcaaaaaccagtcgcaggagttaagagtaacctttcaggtttgacctactccgccgaagacaggatgcttttcgccgttattaataatccccctgaactggtctggttaacgacagaagggcagctggtaggacggatgccgctgcagggcatccacgacccggagtctattgcatggagtgggggcaaccagttccagataggcagtgagaaagatggcgcggtctataaaacacaggtggatattcagcgcggcaccatgcagataatctccatggtgaagcttgagggctatgacaaagcaaaaaataaagggctggaaggtacggcatgggatgcgaaaaatgagagattatatgccgcaaaagaaagaaaacccattatgatcaaagaagtagagatgagcaaaaatggtatcaccagagcgttgccttctgccatcactgcgagtgtgagcgatgtctccggacttgaataccatgccccaacggattcgctgctggtgttgtcggacgagtcaaaaatgattcttgaggtcagttccgagtggcgggtgcgcgatcgattgttcctgacggcggagtggtcagggctcagagacgatatcccccagccagaagggattgccatggataatgaaaataatttgtatattgtgagtgaaccaaatctgttttataaattttcgtgtgatatacagaatgactaaaatctatttttactgtcacagtatgctaaaacagaacaaggttattaataccatgatttgacgactgtttgattcgttgattcattgttggggatatttatgttttacttacctcagtaacggattactttgtggtgtagcgtaacggtaattgtcctcctcatatttgcggcagcgtagtctgccgctttttttgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcagaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaacacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttataggcgcatctgaaaaacctccggctatgccggaggatatttattttataaattaactctctctgtaataattaacagacaatgaatattattctgttttttcagcaggcctccgaagagacctcgcatggtgatgtttagttatcaggcatgattttcttcatcaacacttaccgaatgccatgtcgcctcgctaagcgaaatcatttcatctacgccggaactcttgttaaccgggtttttcgtcggcgatgtgcctgtaaatgttccactggcggtatagtccgtatcgttgaccgtgaccttcacctgaatatcctgatgcgcctccacgactcccttaagggtgacggtgttatccagactgctaacagtcgatcccaacgttggttcggcggacggttgtgtatccatagtcagcttaattgttgcgtgagcttctaagcgacccgataaaggtcggtgtattgatgttagtgatattatcgcctccggcgccgatatcactattatcctccatggaacgtactggcggtgtagagtctatcgtcagccagccgatagacagcgaagaattatccatagcgtttgcggaacgatctctgaagatgatatccagagttgccttgcctaccactctaccaacattttaggaaaaattacgtaatatcgactgatatgtaaaactcattcagcatcaaatggattaattcaacatcagtagtaatatccatttttttataggctgatctcttttgtgttgaaatcgtttttatatttcgatctaataaatttgagcaacttttaacagataatcctgctgccacgtaataaataacttttttttcgctcaatgttaggtcgaattttttagcgagcaacagaatcccatctcttatattaatatgttttgctttgttcttatactgcattgtcagatatctcaattaacatattgatgacgagaggaagataaaaacgctaaaaattccgatggtgtagttttgaaatgttttttaaaaacgcatgtaaaataagaagcactatcataaccacacatataagccactcgagtaatattatattcactattgcgtggaagttttgtcgctttattcattcgcgcattaaggtaaacttcgctgaatgaggtgtgctcttgtttcaatttcctttttaatgtggaacaactcatatagagtgagtcagaaatatccttgagcgcccattttcgacttatgtcgcttataataatattatagatgttttcggctaatgtattttgcgatagttctctgaagagagcaaatgcttcaggttcatagatgaactctgaaagcagaaatcttattaaatattcctttttatcttgggataatttctggcttttatttgaagagtgtaagaggttgaatactcttgctacgcctgtttctattggcgctaacagatgttttgtcgtcggttttgttaatggggccgaaaagtctgcatgttcatacagaaaaaaattataagcattttttattgacgctgaatctaattcaattaaattataatttaactgttcatgagtctcttccatagtgatatgaatggtttgatctttagctaaaaatattaacattggccctgatgccgtaatatactccccggacgatgtcgtaattgaaattttacccgtggtgagcttgatgagtacggactgcagtaaatttaatccctgaagtgataaggatttcctctgccagttttgcgctgattgtaaacattcaatgctccccacctggacaggtgagggattaaatacttttagcatgataatttccttttattaaatgtgcgtgtaaatcaaaattattctgaaaaatatttcaaaagaaaactaatatatagctatataattatttgcgaacttaaggtatcaggtggcgatcttttcattttctatggaaaatgctattttatattgcatttctacatattatagtatcgttaaaaaactatgtcgcgtataaaaaaaagatggaaatttacaagaattggctcatgttattatcaatttatctctttaaaatttgaattaagtaataattgcctttaatcttttagagaatagctctttaatttcatggaggtagttagcatgaggtataagatctgatgttaatttgtgataaggtttatcctggatgtaaatattaacgctctcggccaggaaaggcatacaacgcggtaaatatatactgcggcgggtagacggtgtagcgatatccggaagtttgaggggaggggaagcattcaatcgtatggttggctttatgaaaaacggtgtaacacgttagtgaggttcttactgtgcgtatccgttaggtttatgctttctgattatataatgttgcgtgttttggcacggcagtattgaatcttttgctgcgtcggccccgaggaggaatcactcacagcgaatgccagcgcacagcctggtcctgaatctctaaatgagtagaaaacctttcggtttgatactccggttctattccttctaaatttatcgtaatgacatctgcgttacgcgtgttgtatgcttaatatccacagaagtacaagaggacaacactatgccagccgcaaacagtatggcgatgaaacgcgaaaccctgaacctgcgtatcaaacccgccgagcgcgatcttatcgatcgagcggcgaaagccagagggaaaaaccgcacagactttgtgctggaagctgcccgcgctgccgcagaggaagcgcttatcgaacaacgcatcattatggccgatccagaggcttatcaggagtttctcgttcgtttggatcaaacaccttcacctaatgccgcactgcgtaaaaccatgcagacccctgcgccgtgggagcaggaaaaatgatctccacccctgagccgcttcatgccggacatattcttactccgttttgctgcggtgtggattctatagataactggctggaacagcgggcgatgaaaaatcagaccactggcgcgtcccgtacctttgtgtgttgtggcagcgattcgaacgtactggcctattactcgctggcgtccagcgcggtcacgacgaatacctcccccggtcgctttcgtcgcaatatgcctgacccgattccggttgtggtattggggcgtctggcggtggataaatcgcttcatgggcagggcgtcgctcgggcgctggtacgcgacgcagggctgcgggttattcaggtggcggagactatcggcattcgtgggatgctggttcacgccctgtcggatgaagcgcgggaattttatcagcgggtggggtttgtaccgtcgccgatggatccgatgatgttgatggtgacgttgggggatttggtggagagtgtttaaactccagaacgcatcccttagcttctgatggccggaattcgctgtggatagtcagtgagccagaccggttttaccgcttcagccggacaacgacgtcatgacggtctggacggactgcaaacgggggaagggggcgttgaattcatgcgaatcggggaaaccaaaggcattctccacgcccggccgcccctacgcagttgcacttcctttcatttgctgtggccagtttgcgggaagactttcaccttcagtaattaagtttggggtgatcttctttactcaataaattatttttgtcgttcagctcctcacggacttttgccagtgacttctgaaaagccgggattgtttgcagtcttgcaaactctactgctcccacataacggccagcatcaacatcgctttgccagtgagcaccgcatatcactctgctttgcccgaactcccatccgcgtctggcgagctcctgcgcgcgttccggtctggcctcggataatactaatgccagaagtgtaccataagcagtatgcccggaagggtaagagccattttttcgcaaagtattctcatcttcaggacggcaggtggaatgattaaataagacaaaggggcgggtacgcatataatatttttttgccgaagcagtagcgtagtagccgcccattgtcagaagattctttaacatattccaggtttctggcgtatctttggggttaattttagcacccactactggcgagaatattctggctatattttccacgcttacatctgcatcctcagcagcttgtttccatcgcggggaaccctttatcgcatagcccttaaaataagcctccttatcatagcggtaagccggatcatcattacctggcggtggtggtaagtagaactgactgttcactgattcttcaggagaatgaaagggttgcactgtttctgctgatgtatatttagctacgatcagtggtagaaaaaatactaaataacgacttttcataaagactcactccggatcaggcaataataaacagatgtaatcctataatgatttattgcaatggttattcaacatacaggtaaaaaagcaggacgctgccctggcattatcgtctgtccataccggactgactgcagcggacaacagaacaataccggtacttccggctaacagcattttgtttaacttttgtccccgattattttttatctacgtgcctgactgacacgcattaggttaaaatctttccgtaataacacagtatgaataattattttaaagtatgtgctctgttaccccgataactaccatcagtcatgatgtgctgagtattaatttatgattatgaacaagagtcggaaacagtatttaagaataaagaaaccgaaaaagaaaaaatgctaaaattggcgaagggattattgttatcagtgatgaaaaagttcatggcggagatattggattcacttgtcggggttagcgaaccgtcagatggagtgatacgcgttattactggtaataatctccctgtagctaagtaagctttcctgacaggcgtgataaaagttccgcgcgataaaaaggcttgtacctggcattataagactcgcgtcctgcagaaacagggcagggaagggctcggcggttttaatcaggtatatctgttaaatcacatccttcaactggagcagcctttgttttaaccttcctctcatcgggccggaatgcttcgcctgcgttgatgtagcagaaaccggagaaatcacgccatccgatttcttgcaaatatcaggcgcaaaaaaacagacttgcgctaacaagtctgttctttaagagcctttcttttaacaacaagtaacagcgttacatcgtgtttttaccggcttgcctttgtgtccgtcagcattgcatcttgcaaatctgatcaaccggctttgaatagtggtgcggactcggagtcatattcacgattaacgtgctgtttgttattggttttgttggtatttcttacaaacagcgctcccacgaaggccccataaaaaatcgctttatttttgtgatggttatcacgaaaaatcgtcgtttaagggtagggcttcgttatgtgtcctggtccatatataacgccagaatgagttggtttaaattttcaccaaaaagtcgcttctgaatcgacaaatagagtaatttttcaacccgtcgacttttcacccagaaatcacacaccgctcctcaccgtaccatagctgtgaacgctccaaatccacgaattccccctcatcgtcaataagctcctgaagggcgcttaatccttcttctgtttttcgggctgcaatatgcgattccagactgtcccaccacaactcggcgcaaccatcaaaatcgacgggcaatgaatttcttgtctgctgaagcgctgattgcgcggcactgttcgccaggggaactgtctggatgtacttacgaataccaagacgttctgagtgtttaaccaccagtgaggcatgttggttacgccagtaatgatcaaattcttctcgcgttaaatgggcacgccttttgacgcacatgactagttttaacatgttgctactcctgtcatttcgggagttcaaagcttacactctgacagcggtgtcagagtcaagaggacgttatgcagattggaaaactggcggcattgactggcgttagcatacggatgcttcggtactacgagagcgcaggtttgcttcatccttcgcgaaccgatacgggctatcgcagtttctcgtcagaagatgtggatattgtcagacggatacttattctaaatggtgcaggtttcacgttaccggttgtgtgtagtttgctgaactgcgtacatgcaggaacctcaccttgcgaggaactaaaagctaaagtgcgagaacaactggcacagatagaccgtcagtttgacgcgctctcggaaagccgcaatcttctcaataagtttcttaatgactagcccctgacaatttaccttctaacaccatgtgggaaatggattctactcctccgattgaacattgttcaaattcacatttgatattgaccctggcccaaagatgagcggctgatcgacgaagcgctgggcgttgcgccagagaaaatctggccttctcgttatagctagtcaggccagagatgggggctacggatttccattcccagaaaagcaaaaacccagccataggctgggttttctgaataagtggtgcccggactcggaatcgaaccaaggacacggggattttcaatcccctgctctaccgactgagctatccgggcaacggggcgcattaaaccgtaaaggggcgcggtcgtcaacggctttacacgaaaaaagtgataaaagcgcgctgactgcctgcttttcaggcaaaatgcataaaatcagtacccgtcaggtgagcgctccaccctgacggcactgtgcaaaacgcagaatatcttccgccaaccgctgagcggtatctacatcagcctgactgcggttgaccagcattcggctgagacaaccttccagcaccagctccatctgccttgcaaccatcgccggatcgtcaatttccagcgtggtcagtagctcatgggtaaaatcatgtgccgcgcgtttttgttgattagccagttggtgaataggatgggttgggtcgggataaaacgtacaggcggcaatgaacaagcaaccaggataacggttattactgacacattccgaaagcgcgctgtagcgtgccagtagcttttgttcagcagaaagcgtctcatcaagaagaagctggcgtcgccagatatctacctgctgactcagataacgtagcgcgtcatataaaatggcttctttatctggccagaaacgctgtaatgtgtcgagtgggcgatttacgcgctccgccaccatttccagcgtagtatcggctatcccttgcgtctccagtaatttcagggcttctcccagaatatcttcacgttgcacggtattctcctccgtctttgcttttgcaagtgtcgctcacggttggcgatcgtgcaaatgcgcgctaaaggtggcggcgtccataaagccggtgactcgcgattgcggctgttcctggccttgggtattaaagaacagaatggtgggcagcccgaggacttgcagatgctttaacagcgcgacatcctgcgcattgttagcggtgacgttagcctgcaagagcaccgtgtcgccgagcgcctgctggacccgcggatcgctgaaggtatacttttcaaactctttacaggccacgcaccagtcggcgtagaaatccagcataacgggtttgcctttggcctgcgccagcgcctgattgagttcatccacggtagaaatagccgtgaaattgaggtgcgctggagcttgcgcggatggcgatccgaacgcccaatcctgtagaggccgcacgctaatgagcgctgccgccagcaggataatctgtacgatacgcatccacgctcgtctggcctgaaggctggtgataaaggcccaaccaaagaaagcgacgcccagcagcgaccacagacgtaaaccccaagcctcgccaataatccgctccagtaaaaagaccggtaacgcgaggatcacgaaaccaaaagcggttttaacatgcgccatccacgggccgcttttcggtaacagacggttgccaaacacggtgaccagcattagcggcagacccatacctaatgcatacaaatacagcgtgccgccgcccagccacatgttgccgctctgagcgatataaagcagaatcgcgcttaacggcgctgtagtgcagggcgagcaaattaatccggcaatcgcccccataacaaaaacaccgccgggcgagccgccttgctgacgattactcattaatgtcagccgggtttgcagtgaggaggggagctgtagtgtgaacaggccaaacatcgacaacgcaagcagggtgaacacgatggcaaggccgattaacacataagggtgctgcagcgccgcctgaaactgtaatcccgccgcggcgacgaccagacccagtgcggtataggtcagcgccatcccttgtacatagataaaggccagcagcagtgcgcgccccgtcgacaaacgttgccttccccccaggacaataccggaaatcagcggatacatgggtaaaacgcagggcgtaaaggcgatgcctatgccgatcagcagcgcccagagcgcggaaaaaggtagctgggcggcgggttttgacgtctcactcgtctgggtgacagcaggcgtcggcgtggcgtctattgccgcggcgacttcacttagcggcaccgttttcgtttccggcggataacagaatcccgcatcggcgcacccctggtacgttaccgttaatgtcgcgccagccgccgcctggttaaccgttactggaacgtttagccgcttacggtagatttcgctttttccgtagaactcatcttcatgccagacgcctgtcgggagttggactgcggcgatatccgctttcgtcggcgtgatactgatttgtttacggtaaaggtagtaaccctcttttacctgccaggagagggtaagatcgtgttgattttgctgaaaatcaaaaacaaacgcccggtcggcagggacgaactgcgagcgacccggcgcgtcgaataatccggcgaaggcggatgtgctgcacagcagcaggatcagcgtaaagatgcgttgagccatgagaggtaatcagtatctccgtgagtaacaggtaaaaccagaagttcaggcgtttgatacgggtgatgagacttcaggcagtcgataagcgcttgctgatgtgaaacggtggtttttaagatcatttgaacttcatactcctgctccagtttgccttcccagtagtacagcgatgtcgcgccggggaggagggtggcgcaggcagccagtttttccgccagcactttggcggccagatcctgggcggtagcttcatccggggcggtacaaagcaccacaacggcctcggggatggaaatatcctgactcttaacatcaagcataaacacctcgaaagaacaaaaagacccgcaagtgaacggtcactatacaacggacgagggcaggatgttagtcaaagggcgggagaatgcggggcgtgatacgccccgcgggtgaaacacttacagcataaagctgcccagcaggaagccgaagcagacagccagaacgacgcccagggtgcctgggatgaagaacgggtggttaaagacgaatttaccgatacgggttgtaccggtgtcatccatctgtaccgctgcaaccagagtcgggtaggtcggcaaaatgaacaggccggaaacggcggcgaaggaagcgactgccgtcagcggagagacgttcagcgccagcgccatcggcatcagcgctttcgccgttgccgcctgagagtagagcagcgcggaagcaaagaagaagatgacggccagcagccacggatgaccctggatgacgctacccgcagtgtctttgatccagtcgatgttagcggatacgaaagtatcgcccagccacgccacgcccagaatacagatacaggcgctcatccctgctttaaaggtactggagttgaggatggcgtcagtttccactttacacaggatggtggtcagcgttgcgacgctcaacatgatgatcaaaatagcgttggtggtgttcatcagcggtttctcaaccaggccgaggctcggactgttaacaatcgcataaacaaccacgcagataacgcccagcaggaacagccagacggaattttttgccattggtttgatttcaatctgcttttcaccacgcagttcaatcagcccttcttccagacgcttgcggtaaatcgggtcgtccgacagtttggagttgaacagcatcgtgaccaggaaggacatcaccagcaccgccagcagcgtagaggggataaccacggacagcaggtgaatatagctaatgccatgaccttccataacagaagacatatacaccacggccgcagaaatcggcgaggcggtaatcgcaatctgcgcggataccacggcggtcgagagcggacggcaaggtttgattccctgctccttcgcgacttcagcaataaccggcagcgttgccagggaaatattcccggtaccagcaaaaatagtcaggaaataggtcacaatcggtgcgaggatagtgatgtatttcgggttcttacgcagcagtttttccgtctggtttaccaaataatccagaccgcccgcgacctgcatagcagagatcgcggcgataaccgccatgatgatggaaatgacatcgaatggaattgtccctggcttcacgccgatggcggcaagtaccagaacacccagcccacctgcgaatccaataccgatgcccccaagtctggcgcccaaaaagattgccagcaaaacaatgataagttcgacaactatcatattagccttccttgttgtttaacaagttgatattaaattgttgttatttggtaacttcttgtaagaaaaaaggcacgtcatcgtgacgtgcctctttggtactaccctgtacgattactgttcgctttcatcagtataacgtttagctttataagccgggtgcatcaagttctgtacggagaaaatatcgtccagctcggcttccgttaacaggccgcgctccagcacaacttcacgtacgctcttaccggtttcagcacagattttaccgacgatgtcgccgttgtggtggccgatgaacgggttgaggtaagtgacgataccgatggagttataaacgtacccttcgcacacttctttattcgcggtaatgccgttaacgcatttttctagcaggttgtagcacgcgttgctcagaatgtggatggattcgaacatcgcctgaccgataaccggctccataacgttcaactgcaactgaccggcttccgccgccatcgtaacggtggtgtcgttaccgatgactttaaagcatacctggtttacgacttccggtacaaccgggttcactttggctggcatgatggaagagcccgcctgcagttccggcaggttgatctcgttcaggccggcacgaggaccagaagagagcaagcgcaggtcgttacagattttggacatcttcactgccaaacgtttcagcgcgctgtgaaccataacatatgcgccacagtcagatgtcgcctcaatcagatcttcagccggaacacaggcgaaaccagtgacttcagccagttttttcaccgccagcggagagtattctttcggcgtgttcagaccagtaccgattgccgttgcgccaaggttgacttccagcagcagctcagcagtacgctcgatgcttttcacttcttctttcagcaggatgctgaacgcacggaattcttgaccaagcgtcatcggtacggcgtcctgcaactgggtacgacccattttcaggatgtcctggaattcaaccgctttacgttcgaaaccttcacgcaactggttgatggcatcgatcagtttgacgatagaggcgtaaaccgctacacggaagcctgtcggataggcgtcgttagtggattgacatttattcacgtggtcgttcgggttcaggtactgatattcacctttctgatgacccatcagttccagcccgatgttggccagcacttcgttggtattcatgttgacggaagtgcccgcgccgccctgatagacatctaccgggaactggtccatgcacttaccgttgttaaggacttcatcacatgcggcaatgatggcgttcgccacactcttaggaatggtttgcagctctttgttggccagcgccgccgctttttttaccataaccatgccacgcacaaattcagggatgtcgctgattttgttattgctaatgtagaagttttcaatcgctctcagagtgtgaacaccatagtaggcttcagctggaacttccctggtacccaacagatcttcttcgatacgaatgttgtttgacatgtgaaccttctttttcaagctgccaatgatttttactttaaaacacacaggatatatgtgatttcgaatgttttctgaccgacgattatcccctccatcggcctgataaacgagatcatatgctggttcagaattcctaccgtaatctggatcacttaaagtgtgggaatttaccccttatttattattttgtgaaataggtcaccgctttagtattactacctaaaataggtgtacaaaccacttgaaattttgctacgcaccaccatatcgaatcgatgcgaatcgcaaccccattcaaatggtcgtcgcagacggccatgacttacaggagagtcctttgcgctggataccctttttagctgtctttctctatgtttacattgagatttctatctttatccaggtcgcccatgtgcttggtgtcctgatgacgctaatcctggtgatttttacgtctgttatcggtatgtcgctggtacgtaaccagggttttaaaaactttttgctgatgcaacaaaaaatggcggccggtgagagcccggcggcagaaatgattaagagtgtatcgctgatcatcgctggcttactgctcctgttgccggggtttttcaccgattttctcggccttctccttttgttaccgccggtgcaaaaacatttgacgctgaagttgctgccgcatttacgtttttcccggatgccgggcggcgggtttagcgcgggtactggcggtggcgaaacatttgacggcgagtatcagcgtaaagatgacgatcgcgatcgtattgaacataaagacgatcgtcgggattaaaggtagagatgctggccggataagtcgcgtgaggcgttatccggccaacagatacgtcttacgccatgcgttttcgcttcggtaaaaacagccataatgctgccagcatgataatggcatataagcttttccaccccagcattaccagcaataacaggcacagtagacaacccgtcaccgccagtgcatagcagcgccctttcaatagtcgacagcccgccagcatacaaagcagatagagcataataaaaataccgttagcatagacgatcagcgcattgaggttaatcttcagggcgtagacgaccagggaactcacgcaacaacaggccagaataacgtttaacgcgtgcaagggaaggcgcccgggagagagttgagccagatagtgatcgggctgatattgcatttgcgtccatatcagacgcgcaaaactctgagcatacacattcaggctggcaaagcaggtgagataaccaataatgcaggctatccacaacgcctggataccgaagagatgaacaataataagcggtagcgatgctgttgccgctatcttgtcgctatagacgccaaaatgcagcaccacggcggtacaggtccaataaatggagccggccagcatcaggccaatgatcaatgcgcgcggaaaatcacgttcaggatttttaaattcagacgacaaatgcgtaaaagcctcaattcccacaaatccccagaacatgatcgccagggcggtacacagccgggaaaaggtgatttcgtttgcggctgggaaggtgatatctgcaggtttaatcgcgcctttccacagaatggcggcaataagcgcgataattaatccagcgataatggcttgcaggttggcgctggagctggcgccgcgcgatcccataaaccatagtaaacctagagtacccagctccccaaataagagctgttcgctttgccagccaaacagcgcctggccgaaacccaccgcaatatgcaaggctgcgggaaaactaacaggaatgactgataaaaacagccaactgatcacccgttgcagacgcgggccaaatgccatcccgacaaaatgcgctacgccgccagcgtgtggaaagtgacgccccagcacagcaaagacaatcgcaatagggaaaatcaaaataatgagcagcggccatgcccaaaggctgatgtcgcctgccgccagcgcagccagctccggaagcgcaaaaacgccagtccctaataatgatgtggttaacaagataacgccctgaaccaacccaagctctttttttagttcattcatcagctcattatccggcggcattgtaacgtcaggtgacgacagacatttttaagcgtatcacacacgccttttcttatagcaggatgttctaaaccttgggtaaacgtgagataagtagcgtttttaccgcttttttcgctcagaagaattttttttcatctccccccttgaaggggcaaaaccccatccccatctctctggtcaccagccgggaaaccgtttacgggccggcgtcacccataactgataatgactttctcaaaggagagctatcaatgagtattcgtccgttacatgatcgtgtgatcgtcaaacgtaaagaagttgagtctaaatctgctggcggcatcgtactgaccggttccgcagcgggtaaatcaactcgtggcgaaatcatcgctgtcggtaagggtcgcatcctggacaacggtactgtacagccgctggacgtgaaagttggcgacatcgttatttttaacgatggctacggtgtgaaatctgaaaagatcgacaatgaagaagtgttgatcatgtctgaaagcgacattctggcaattgttgaagcgtaatccgcgaacgacactgaacatacgaatttaagggaaagagaaaatggcagctaaagacgtaaaattcggtaacgacgctcgtgtgaaaatgctgcgcggcgtaaacgtactggcagatgcagtgaaagttaccctcggtccgaaaggccgtaacgtggttctggataaatctttcggtgcgccgactatcactaaagatggtgtttccgtagcgcgtgaaatcgaactggaagacaagtttgaaaacatgggcgcgcaaatggtgaaagaagttgcctctaaagcgaacgatgctgcaggcgacggcaccaccaccgcgaccgtactggcgcagtccatcattaccgaaggcttgaaagccgttgctgcgggcatgaacccgatggacctgaaacgtggtatcgacaaagcggttgctgcggcggttgaagagctgaaagccctgtccgtaccgtgctccgactctaaagcgattgctcaggtaggtactatctccgctaactccgacgaaaccgtaggtaaactgatcgcggaagcgatggataaagtcggtaaagaaggcgtcatcaccgttgaagacggtaccggtctgcaggacgaactggacgtggttgaaggtatgcagtttgaccgcggctacctgtctccttacttcatcaacaagccggaaactggcgcagtagagctggaaagcccgttcatcctgctggctgataagaaaatctccaacatccgcgaaatgctgccggttctggaagccgttgcaaaagcaggcaaaccgctgctgatcatcgctgaagatgttgaaggcgaagcgctggctaccctggttgttaacaccatgcgtggcatcgtgaaagtggctgctgttaaggcacctggcttcggcgatcgtcgtaaggcgatgctgcaggatatcgctaccctgaccggcggtaccgtaatctctgaagagatcggtatggagctggaaaaagcaaccctggaagacctgggtcaggcgaaacgtgttgtgatcaacaaagacaccaccaccatcatcgatggcgtgggtgaagaagctgccatccagggccgtgttgctcagatccgtcagcagattgaagaagcgacctccgactacgatcgtgaaaaactgcaggagcgcgtagcgaaactggcaggcggcgttgcggttatcaaagttggcgctgcgaccgaagttgaaatgaaagagaagaaagcccgcgttgaagatgccctgcacgcgacccgtgctgcggtagaagaaggcgtggttgctggtggtggcgttgcgctgatccgcgttgcttctaaaattgctgacctgaaaggccagaacgaagaccagaacgtgggtatcaaagttgcgctgcgcgcaatggaagctccgctgcgtcagatcgtgctgaactgcggcgaagagccgtctgttgtcgctaacaccgttaaaggcggcgacggtaactacggttacaacgcagcaactgaagaatacggcaacatgatcgatatgggtatcctggacccaaccaaagttacccgttctgcgctgcagtacgctgcttctgtggctggtctgatgatcactaccgagtgcatggtgaccgacctgccgaaaagcgatgctcctgatttaggcgctgctggcggcatgggtggtatgggtggtatgggcggcatgatgtaattgcccaccccctgcatccttcaggctgcagatgcgttggctaaccccagtcacttacttgagtaagtgactggggattaacaaactggccgccttcctgcaaccagaatgatttgggtgcttatctcccagaattgagaaacccccgggcagaaatgaccgggggtttttcttttagtcatctttttagtataagattcagatacggacaaaacgtccagctcattgattatggggaataacatgcacgtgaaatatttagcagggatcgttggcgccgcgctgctgatggcgggttgtagctccagcaacgaactcaccgctgccggccaaaatgtacgctttgtcgaagataagccgggcgcggaatgccagcttattggtacggcaactggtaaacagagtaactggttttcaggccagcacggcgaagagggtggctcaatgcgtggcgcagcgaacgatctgcgtaatcaggcagccgcgatgggtggaaacgtgctgtatggcgtaagtagtccgtcacagggcatgttgtccagttttgtcccgacggccagcgagatgaacggccaggtttataaatgtccgaactgatatgtctgaatcgtaacgccctctgaaagattcagagggcgatatggttagcgtttttcctgcgatgatgccatgcgtagattatgcaacgcgcgcatgcattgatcttgcgtcagacgcgctgctttaccggttccaagcgttctgacaaaaaccttacacggttttccttccagctttttaagacgcgggctgaaattcagcaagcggcgtgatattgcttcagcttctttagagcctgactgactacgggtcttaatgatggtgccgcaatcatgcgattgtcctgcctcatccgtataacgataaacgagcgctaaataatggttatacagattatgtttccagtcaggctggttataggtatcgaattcgatattaccgttttccaggcagtcagcatcgtataatggtaaaaagtccagcattgaagaaatacgcaatgcgagctcacgcatttcggcattattaatggcgtgaataatagccatcaccagaacttcaacctgccactcaccgacctgtaaatcaagatggctaccattgtgcagctttaacgtaaaggttaatactttttctgtattatcgctcaacgctaaagattcaacacgctgattaacatcggcgttttccagctcttcacggagtattgccggaatattctcatgcattttaagcacatgactgcttttagctttctggcgtttttcctgctcttgttccggaagcgagtgttgtagataaagccggtgttcaaggccgatcaacaagtctcgcagcgcgagcacaggaaagaaaagcagtgtttctttatttctcagtgacttcaccttaagcgccagcgcgataaacttatcattgtgacgaataacgccggtatttagtcccttaatcgttaaggccatgtcaattctccacaaatataaaataattaaatgttttactgcaatgtatttgatatataaattgtttatgccgtcctataaaaaggagaaccagtataattcgaaaatgcagtacacgctaagcgagtcctaaaacggactttattgaaaagagaggaccggaaaggtgtatttaacgaaggttagtttatcctcgccaaagggtgaggagaatcgcgggggagtctcctcgtaatattgcgcggtaatatttttcgtcgtccctgacgcgcccgcgaggattagcactgccgaagctgtaaatccagcggtgttttgctcggttcgccgccgatttcacgcgccagtcttggcaccatatagccggataccagcgtgagcagttcgcgcatgatttgccgggcttcgtcatcggtgaccataaaatgcgcggcgccctgcactttatccagcacatgcaggtaatagggcatcacgccggcgtcaaatagcgcgttgctcagattcgccagcgttcgcgcgttatcattcacgccacgcagcaggacgctctggttgagaagcgtgacgcccacgtggcgcagtttcttcatcgccaggccgaacgcctcgtccacttcattagcgtggttgatatggttcaccaacaaaatttgcagacgtgactggtcaaagcgggcgaccagttcgtcagtaatgcgtgccgggatgacgataggcaaccgactgtggatgcgtagccgcttgacgtgcttaatggcttccagttgcgtgagcagccagtccagctcatgatctttcgccatcagcggatcgccgccggaaaagatgatctcatccagttccgggtgtgcggcgatatactccagcgcgactgtccagttgcgcttattgccttgattctctgcatacgggaagtgacgacggaaacagtagcggcaatttaccgcacatccgccttttaccagcaatagcgcccggttttggtatttatgcaataatcctggcaccacgctgtgttgctcttccagcgggtcggtggagaaaccgggggcgacaataaattcatcccgggacgtcagcacttgacgtaaaagaggatcgtcagggttgcccttctccatgcgcgcaataaaagcgcgcggcacgcggagggcaaacaagcgcctggcgtcctgtcctgcccggaggttttcatcagcttcaatctgtaaaagatgcagcagttcgtcgggattggtcacaacatcggcaagttgcgctaaccaatcttctcgcaatggggtatttagggttacaatatgcgccattttgtggcttagctaccagttaacaatttcagagggccttatggcgacttactatagcaacgattttcgttccggtcttaaaatcatgttggatggcgaaccttatgcggttgaatccagtgaattcgtgaaaccgggtaaaggccaggcgtttgcccgcgttaagctgcgccgtctgctgaccggcacgcgcgttgagaaaaccttcaaatcgaccgattccgcagaaggcgcggatgtagtcgatatgaacctgacttacctgtacaacgacggtgagttctggcatttcatgaacaacgaaaccttcgagcagctgtctgcagatgccaaggctatcggcgacaacgcaaaatggctgttggatcaggcggaatgcatcgtgaccctgtggaacggtcagcctatctctgtcactccgccgaactttgttgaactggaaattgttgataccgacccaggtctgaagggcgataccgcaggtactggcggcaaaccagccacgctgtctactggcgcagtggttaaagttccgctgttcgtgcagattggcgaagtgatcaaagtcgatacccgttccggcgaatacgtatcccgcgtaaaataatttacgttatcgggaaaaatggtgcagcgtatgctgcgccatcctatttttcgcgcctcaatgatgaaacgctttatcggtcttgtcgcgctggttcttcttaccagcacattattaacggcatgtaataccgcccgcggcttcggcgaagatattcagcatctcggccacgccatctcccgtgcagccagctaatcgcttctcgtcttcctaaaattagtcgatcgcccatcattttctgggatgttgtctattattaagttgctatacacaaacaacattggctagaaaaggaagacattatggttaaaaagacaattgcagcgatcttttctgttttggtactttccactgtattaactgcttgtaataccacgcgcggcgtgggcgaggacatctcggacggtggtagtgcgatctctggcgctgcaaccagagctcagcagtaatcatcaacggtacggcatggcgtcgtaccgttaatcgattttctccggaagcataagaaagggagaataccggttatccatatgaagtttcatacggatattacgtttataggtgtaaaccgttttcccgtgaatgccaagcgcatacgcaatctctttattgctggtgccttccgtccacatcgcgagcactttttcctcctgcggagagagcaatggcgtggcgctttccggcgcttcctgcagtggatgagtatgtagcgctcctttaattcgttgtgcaagctcatgtaaaggcgtgtgtttagataacaccgcatgactggcatattgcggtctgtacggcatattccctgactgtaataataccaacggcgtcatcctgcaggcggcaaaaaatgcattgataggctgttcgggtaaggcatcgttgagaaaaccatataaatcagcgataaccaggtggggcttccattgcagaatatgttctttcgccagtataaggttattcatcccggataccagcagtgaagaactgagcacatcagtgtgattaagccaggcctccatgcccgtacgggtaaagtggcatcggtctatcactaaaattttcaacatagttttttgcacccggaagtagataaagcactttctttcccagaaggcgttccatcatagagaactcctgtgggcgctaaatgcgaaaactacgcggcttaaaagggccaattcccgcctttagacggaaaaaaataaaaaggttgaaattcattttctctcaggcaagaatggcttttcatccgtatacgttacaggacgacctgtaaacgctattctcaccggggacggccccattaattatctggagcctgctatgtcctggatcattctattaatcgctggtttacttgaagtggtatgggctgtcggcctgaagtatacccacggtttttctcgtctgacccccagtattatcaccattacggccatggttatcagtatggcgttactttcctgggcaatgaaaacgctgcctgttggaacggcgtacgccatctggaccggcatcggcgccgttggggcggcaatcaccggtatccttctgctgggcgagtctgcctcaccggcgcgtttgctcagtcttggcttgatcgtcgcgggtatcattgggctaaaactcagtgcgcattaattcgtcgctgatattgctacgaacctgattgttttacccaaattaatttattgacgtcaaacccctcccgggtcgcgacggccagcatttgctgttttatttcctcagaaagcgttggcgtgcgagagagtatccacagatagtcgcgatccgggccgcacaccagcgcatgacggtattcccggtcaagcgcaatcacgttatagccgccgtagaacgggccgaaaaaagagaccttgagcgcggcgcggtttggactaccggtaaaatacgctttgccttctgttttttgccacatttcccgatccgggttatagcctttattgatgacattaatcccgccatcgtcacgcagactataggtggccgtgacttgttccagtccacgttcaaatcgatgatcgaggcgtgcgatctcataccaggtgccgaggtaacgtttggcatcaaagttatttaccacggtaacgcctttaggcggggtaggcgaactacaggcgacaaccaaaaatgccgcagtaaccgcagcaacgacgggcagcaagcgcatagcgtttttccttccagtgttttttctaagtgtagaacctggcgggaaaatgagaggcaggaaaagaaaaaatgccctcttatcgggtagataagagggcgtcgtggcaacttagagagtgataacgccaatcgccgtcacaacggtcaggattgccgccagaccgtagaagacccatttgcccgcgggcacgtggattttcaggtcatgcatcgcgtggtgcatacggtgtaggccacaccatagcggcagcacgatcatcaggaacagaaaaacgcgaccaatgaagctttgggcgaacgtcagtacgcgctcaaaactcagggcatcgcccggaaatagccccagcggcagcatgatgccaaccagtagcacgatcaccggcgcgatgatcgcgccccacataccgcctgcgccaaacagtccccagaatacgggttcatcagaacgttttgggtttggattaatcatccgggactccttaccagaacagggcaacatacagaatgactacggtgactaccgcagtgaccacccaaagccctttgatgattggctctggccccattttttcgtcttttacaatgatattggccgccttcggcgccagttcaaaccaggttttggtgtgcagcagcgcggccgccagggtgatcaggtttaagatcaccaccaccgggttttgtaaaaagccgacgaatcccatccaggattccgcgccgtgtttgagcgcaaacagaccgaaaatcagttcaatactgaaccagactgccggcaccgctgtgccttcgcgcagcatataaaagcgataaaacggcagttttttccaccaggtggacgtcatcggccgcacatagggtttgcgtttagtcgtcatgttgcactccttagcgtggtttcagggtggcgataagaaagtctttcgagctttccactttaccctgctgaatggccgcagccggatcgacatgttttggacagacttcggagcagtagcccacgaaagtacaggtccatacgccgttcggactgttcaactgcgccatacgctccttcttaccgtgatcgcggctatcttcgttatagcgatgcgccagcgtaatcgcagccggtccgataaattcaggattcagaccgaactgcgggcacgcggcgtagcacagaccacagttgatgcaaccggagaactggtgatacttcgccatttgcgccggggtctggacattcggcccctgatctggcgtgcgagagttgccaataatgtacggtttgatcgcttccaggctttcgataaagtgcgtcatatcgacaaccagatcgcgttcaatcgggaagttcgccagcgcttccaccttcataccgttggtgtaatcgcgcaggaaggttttacacgccagtttagggacgttgttgaccatcatgccgcaggagccgcagatcgccatacggcaggaccagcggtagctcaggtctggcgacaggttatctttgatgtagcccaacgcgtccagtagcgatgttgtttcatcataaggaacttcatagaaagcactgtgcggcgcggtatcggtttccgggttatagcgcaccacctcaactttcaggtttttcatctcagccattcgccttctccttcttatcggctgcttccgcttcaccgccgtaaacacgtttggctggcggcagggtggtgattttcacgtcgctgtattccagacgggtcgtgccatcagcatcgcggaaggcgagggtgtgcttgaggaagttcacatcgtcgcgctcggtacagccttcatccagacgctgatgcgcgccgcgggactctttacgcgccagcgcagagtgcgccatacattccgccacgttcagaccatgacccagttcgatggtatacagcaggtcagtgttgaacacgctggaggtatcggagatacgtacgcgcttgaaacgttcctgaagctcggccagtttatcaacggttttctgcatcagttccggggtacggtaaataccgcaaccttcttccatagacagacccatctcatcgcggatcttcgaccagttttcgttgccttcctggttcaccagatttttcagacgctgttcaatatcggcaacctgggcgtcgagcgcggcgctatttgcggcgcctgccgtagcagcgcgttccattgcttgttcgccagccagacgaccaaacaccaccagttccgccagtgagttggaaccgaggcggttcgcgccatgcaggccaacagaggagcattcgccaacggcaaacagccctttgacacggctttcacagttctggtcggtttcaatgccgcccatggtgtagtgcgcggtcggacgtactggaatcggttctttaaccggatcgacgccgacataggctttcgccagttcgcaaatgaacggcagacgttcatgcagtttcttctcgccgagatgacgcaggtcgaggtgaaccacatcgccgcgcggcgtggagatggtgttgcctttacgccattcgtgccagaaagcctgggatactttgtcacgtggccccagttccatatatttgtttttcggctcgcccagcggcgtttcggggcccatgccgtagtcttgcaggtaacgatagccatttttattgaccagaataccgccttcgccgcggcaaccttcagtcatcaggataccggaacctggcaggccggtcgggtgatactgaacgaattccatatcacgcagcggaacgccatggctcagcgccatgcccatcccgtcgccggtgacgatgccgccgttggtgttatagcggtatacgcggcctgcgccgcctgtcgccatgaccacggcgttggcacggatttgcaccagcgtgccttccatcatgttcattgccaccaggccgcgcgcatggttgtcatcaaccagaatatccagcacgaaatgttcgtcaaagcgctggatttgtgggaactgcagggaagtctggaacagggtatgcagcatatggaagccggttttatccgcggcgaaccaggtacgctcgattttcataccaccgaagcgacgcacgttaacgctaccgtccggacggcggctccacgggcagccccattgctccagctgcgtcatctcagtgggacaatggtggacaaagtaatccacgacatcctgctcacacagccagtctccgcctgctaccgtatcgtgaaaatggtagtcaaagctgtcatgatcctgggcgacagcggctgaacccccttcggcagcgacggtgtggctgcgcatcgggtacacttttgagatcagtgcgattttagcattgggattcgcctgtgcggcagcaattgcagcacgtaatcccgcgccaccggcgcctataatggcaagatcggcttgaaaggtttgcacgacattcctccagattattgtaatttcaccctcgcgcagccagataaagcctctgggttctgcgaagtatgaatgcgtttccactgctcctttatgggtacaacagtatagtctcagggatgtgagggaaatttgacgtgttcgatttttttagcgtatcagagggatgaattatcattgattttgattaatttaattactaaaccatctgaaatcactttttttaccctccagaaggcgcccgatacgcctgcgcaaaatttgtttcgcccgcgcgttgcgagtagacttcgtgaccttgtcttaaactggagaaagaatcatgagcgaaacggcaacctggcagccgagcgcgtccatccccaatttattaaaacgtgcggcgattatggcggaaatccgtcgtttctttgccgatcgtggagtgcttgaggttgagacgccctgcatgagtcaggcgacggtcacagacattcatctgttcccgttcgaaacgcgtttcgtcggacctggccattcccaggggatcaacctctatttaatgaccagtccggaataccatatgaaacgcctgctggcggcagggtgcggcccggttttccagctatgccgcagtttccgtaatgaagagatgggacgacatcataatccggaattcactatgctggagtggtatcgcccgcattacgatatgtaccgcctgatgaatgaagtggatgatttgcttcagcaagtgctggattgtcaacctgcggaaagtctctcctatcaacaggcgtttcagcgccatctggagattgacccgttatcagcagataaaacgcaactgcgtgaggcggcggcaaagcttgatttaagcaatatcgccgatacggaagaagaccgtgatacgttgctgcaactgttgttcacgatgggggttgagccgcatataggtaaagaaaagccgacctttatttatcactttccggcaagtcaggcatcgctggcacaaatcagtaccgaggatcatcgcgtcgccgagcgctttgaggtgtactacaaaggtattgagctggcgaatggtttccacgaactgacggacgcacgtgagcaacaacagcgctttgaacaggacaatcgtaagcgcgccgctcgcggtctgccgcagcagccgattgaccaaaatctactggatgcgctggccgccggtctaccggattgttccggcgtggcgctgggtgttgatcgtctggtgatgctggcgctgggagcagaaagcctggcggacgtgattgcttttacggtcgatcgggcgtaaatctgaaattcactctttcgcgagataaaatggcgcaataagcgccattttgtagcatattttttcaattatcctctgtttgccacaacataaggctggaactttgatgccatttaggtatcaatcctgtgttgatttttttatcgctgaccttcgtaaaaaagaaggcggcgtcaatcggtgagcggcgtctggcaaacgcgctcgagcgtaagggatggttgaatgacccacacgataaaaaagatgagccttattgggcttatcctgatgatttttacttctgtttttggttttgcgaatagcccgtcggcgttttatttaatggggtatagcgcaatcccatggtatatattttctgccttgctgttttttattccattcgccttaatgatggctgaaatgggttccgcttatcgcaaagaagagggcgggatctattcgtggatgaataatagcgtggggccacgttacgcgtttattggcacgtttatgtggttttcatcgtatgtcatatggatggtaagtacggcggcaaaaatttgggtaccgttttctacttttgtttttggcgccgatatgacgcagcactggcgtattgcagggcttgagcctacgcaggttgtcgggctgctcgccgtcggctggatgattctggtgacgtgtgtcgccgccagagggatcaataaaattgcgcgaattacggcggtcggaggtattgccgtaatgtgtcttaatttagttttattgttagtgagtgtcgctattttgttattaaatggtgggcattttgcacaagaaattaattttacctcgtcaccgaatccgggttatcactccggcctggcaatgttgtcatttgtggtatttgctatttttgcgtacggcggtattgaggctgtcggcggactggtggataaaaccgagaaaccggaaaagaattttgcgaaaggtattgttttcgcggctattgtgatttcaattggttattctttggcgatctttttatggggcgtcagcactaactggcaacagatattaagtaatagcgccgttaacttagggaatatcacctacattctgatgtcgagtttaggcacgacattaggtaacgcgttaaacctttctccggaagcagcgatgacggtgggcgtctggtttgcgcgtatcaccggcctttctatgtttctggcttataccggcgcgttttttacgttgagctattcaccgctgaaagccattattcaggggacgccaaaagcgttgtggcccgcgccgatgacgacactgaacgctaacggtatgccggcgaccgctatgtggctacagtgcgtgctggtgagtctgtttattttgctggtctcttttggcggtgacaccgcatcggcgttttataacaaactcacgctgatggcgaacgtctcaatgaccttgccatacctgttccttgcgctggcatttcccttctttaaagcgcgtcaggatctggagcggccatttgttctctttaaaaccaaagcctctaccctggtcgcgacgggtgttgtggtgctggtggtgacgtttgccaacgtctttaccatcatccagccagtgattgaagctggggactgggacagcgccttgtggatgatcggcggcccgatcttcttctcgctgctggcgatggcgatttatcagaattacagtagccgcatgagcgccgatccggagtgggcggcggagtaatctttgtccggatagcgttagctcatcggctttatgaaaaggatatttataatgagtccgaaaatgtttgcgttgtgcgctatctggattttactggctatcccactcatcgctgtattttcagtcctggataaagagtggatgattggcgagagtgggataaccaacatttgtgatgtgatgagaactgtcgaaaatgatgattccagaagttttggcgcgatgatgacgctgcccctgtttttcccatttttttacgttactgtgtataagaaaatacgtagttggtttttgtactgtgtcgcgttggtgatatttgcttactggtcctggcaattcttcctgcgctatcagttttgtgtgtgatctatgctaaaagacctgataagcctatgtcatcgagtcttttagcgtcatccggcgccattgcgtttacaaactccccgccgggcggctggttttacccgctgacgttaacgttctccccgtttgtttaccgccgaggctctccagacgcatctggaacggcgggaacggcatatcaataccgtgttcgcggaagccagccagaatcaattggtggatctcatggcgtaatggcatacggtgtcccatttccgcggcatagatacgcagttcgaaaatctgaataccctgctggagatccaccagaaagatttcaggcggcgggttatcaagcaccaaagaacagcgctgcgccgccgtcagcagaatttgcgtcacctcttcgctattggcatccgctggcgccgggatggttaacaccacgcgcgtaacggagtcagacagcgaccagttgataaactgttcggtgataaaggctttattcggcacgataatctctttacgatcccagtcactgatagtggtggcgcgggtattgattttggtcacgctgccggtgagatcgcgaatggtcaccgtatcgccgatacgaatcggcttttcaaacaaaataatcaggccggagataaagttagcgaaaatttcttgcaggccaaaaccaagcccaacgccgagcgcggccaccagccattgtagcttcgaccactcaatgccgatcatcgagaaaccgaccagcccgccaatcagcattaacagatatttggtgatggtcgtgatggcgtaaccggtaccaggcgttaaatcgagatgctgtaataacgccagttccagcagcgcaggcagattacgcaccaactgcgtggtgatgataaagaccagaatcgcaatgagcaccgcccccagagtaattggctccaggctttccacgccttgcaccgtagaggtgacatcccacagcgaaatattctccaggaagccgaatgccgagtggatttccgaccacagtacaattaccgatagcagggcgataagcatcagaattgagcggaccagacgcagcgactgggcgctaatagcgtcaagatcgatttcactttcatcgatgtcgaccgcgccttccaggctggaggagtgcgccggttcttcttcgccgcgcgcgcgctgcgccagcatttccgcccgacgatgtttggcgcggtcaaaagccagtcggcgtcgttggatcagcatccagcggcgaatgacatgataaataaccagcaacaggaaccagatggcgaccgaggtttccagtctcgccagtagcgcctgcgctgtggccagataacccaccgccgccgccagaatcgcgataagcggcgcgcccatcaacatattccacagcaggctgttgaccatgttgtcgccgttgccttctttatcaagatagagcggaatgcccgcttttttcagactcagcgtgaccagcgccagcgcgccgcatatcaggatgaagcaaaggcggcccaacgagccggaaaactcccgatcgttaagattatcaaacatgatcactgccataatgagcggcacgatcagcccaatgctcatcaggtagtagcgcatcgctttcgctacccggtttcgcggccagccgaaatgcgccacaaacagaccattagggcgggcaaaagcggcgcaaatcatgactacccacaacagcggtactgtcgccgtcacgccatcgccgatggcgacggccagcggatacggccaggcttcctgtagaccatagccgagcgtcgcccacaagacgggcagcggcgaggcgaccagaatcgaccagaacaccgttcgcagcgtcagcgagaagtgatcctgggtgactttcccgacgcgcgaggccgagcgttcaaggaaccggttgaagtgttgacgtgaatagaggctaaacccgaccagcgccagcgcgccgaataacggcagtagcgtctctttgctggtcagcatcatgatgctggctttacctaactgattaaacgtatctaatgagataagccgacgtaaatcctgaaccaaatcaacaggccaggagagcgatagcgggctaacgtcagcggtccagaacagataacggtgggtcgcttcattaacctctttaagcgcatcctccagttggctgttggagactttcagtttggtcagctccaggatcagcgtgtcgccgccctgtaacaacgagttgagcagctcgcgctgagtgcgaagctgggcgtcaagaatctggttttgctcggcggtcagcggctgtccattggcctgacgtatttgccgtagctgcggctgcttattgagtaactcttcatagcgcatacggtggacgcgtagctgcgccatttccgtatcaagctgctgcggcttaggcatctctggcagacgggcgacctgcgcgcgcagcgcttcgccaagcatgttggacacgccaagccattgcgactgctcccgcagcgtattgagcgcctgacgcacctgtaacgtttggctggtggcctgtcgctgctgcgaggcgaccagatccatccgctgcgcttgttgattaagcgcctgtgacagctcgcggttgactttaaattgttcgacgatgccttccggcaaaccggcgctgttttccgccagcagctcagtactttccagcgcgcgttccgcttcacgttgacgcaggctgttgagctgattgcgcagcgcctgaagatacgcatccaattgctgactctgtttttccgccagctcggaacgcagacgagccagttcctgccggttgttggcggacagttgcgccaactccagttcgtcgactaacgcttttagtttggcggactccgcctgcatactgagactttgcgcctggctaagcgcggcacttccgcctgcggcgccgagtcgtcgctcaatctcattaagctggcggcgggcgtcgttttgctgttggggaagctggctgagcgagtcggcgatctccctgacgcgctcctgctcctgttgcgcctcgcgggttttatctagtagctggctgctaacctgcaagatctcctgatttaacgcttcggtggacatctctggcggtacgctgcgaggttcatcgcgcagattattcaactgggcgcgcaaggtggcggatagcttagggaaattatcaataacgtgttgatattgtttcgcgcgctcaagcgagccttttcgctcttcaagcgcgtttaacgcagtctggagcgcctcaacggcttccggctgagcgggcttcgccgcttttgcctgctccagttcctgcgtgatttgtttggcgtcgggggccgttgcggcgaacgcccccgtgctgaggcaccaggccatcagaaaagcgataatcaggcgcacgtcagcattctctcttgattaggtgtcgtcttttttattgtcaaccagcgggctggcgtcgtgttcggctttaatttcttctgccggcagcggagcaggttctacctccggcgcgacgaatgtttcggtcgacgtcgccagcggttggccaattttggtaacggacaggcttgccagcgacgcgatcagattcacttttcccggcgcaaataagttgatgaccgtggaacccagtttaaagcgtcccatctcctggcctttcaacagggcgacagacccttcatgttcgccttctggccaggtccagcgcttgatgatgccttcgcgcggcggggtaatggtccccgcccagacggtttcgatactgccgacaatagttgcgccgaccagaatctgcgccatagggccgaactcggtatcaaacaggcagataacgcgctcgttgcgggcaaacaggttggggacgttttgcgcggtcagatggttaacggagaacagatcgcccggtacgtagatcatttcacgcaggatgccgttgcatggcatatgcacgcgatggtagtcgcgaggggagaggtaagtggtcacaaacgtgccgttgcggaacttatccgccatcaggtagttacccgccagcaacgcctcaaggctgtaattatggcctttggcctgcaaaattttatcttcttcgatacgacccaactggcttatcacgccgtcggcaggcatcaccaggatgttaggatcggtattgagcggacgcacgtcatcacgcagcggacgaacaaagaaatcattgaacgtacgatagctggcggtatccggtttttgcgcctcggtcatatcgactttgtaatactttacgaagagatcgataaccagttttgtcagccatcctgctcgtttgcttgcgccccagcccgccaggcgagtgagccatagtttcggcagaatgtattgtagcgaaagtttaaatgagtttaacaaggtagcctccaggccattgttgttcctgaaccggcagttataccggtatcctgaaaaaaggggacgattctaacgacgcctagcgtatctgtcagtcgtccgtatcagaaaagtttttacgcgtttttacctgcgccatactttcaagaattcggtgataattttcgaaacgggtttccgcaatagcgccgttctctaccgcttcgcgaatggcgcagcctggatcggcgtcatgcttgcagtcccggtatttgcaatgtcccaaatagtcatgaaattcgacaaagccctgggtgatttgttccggctccagatgccataagccgaactcgcgcacgccgggggaatcaatgacatcgccgccatgcgggaaatgatacagacgagcagcggtagtggtatgttgacccagaccggagacattcgacacatcgttcgtcagaatctcgttctgtaagccgagcagagcgtttagcagactggattttccgacgccggactgcccagcaaaaatactgatgcgaccggttaacgcctcttccagcggtttcagaccatcctgcgtatggctggagaccatcagcacgcgatagccgatattgcggtagatatccatctgctcattaacgaagtccataccttcgtcgtccagcagatcaattttattgagtacgataagcggctcaacctgtagggtttcacagccgaccagatagcgatcgatgatattcagcgacagctccggcaaaatcgcggagacgataacgatttggtcaatgttggcggcaataggcttcacgccgtcgtagaagtccgggcgcgtcaataccgaggtgcgctcatgcaccgcttcaacgatgccttttacgttgacgccctctgcggcggctttgcccggacgccagacgacgcgatcgcccgtcaccagcgaacggatagtgcggcggatattgcaacggtgaacctcgccgtcagcagactccacatcggcatgcataccaaaacggctaatgacgataccttctgcaggctcgccaaacaggttgtcatcgtagtcggctttctccgcggacgtttttaaacgacgctggtgattggcgttcacacggcgctgctggcctttggagagtttatttttgctcaatcgtactggctcctggtcgcccatagtgggcaaaacatctatgatacacgcaattgtagatgaatatagtcacagtgaatgtgacctctgaagggtggaaaatagcatgagtgccgatgaaaacaacctgatttggatcgatctggagatgacaggtctggaccccgagcgcgatcgcattattgagatagccacactggtgacggatgccagcctgaacattctggcggaagggccgacgattgcggtacatcaatccgatgcgcaactggcgttaatggatgactggaacgtgcgcacccataccggtagcggcctggtagatcgcgttaaggcaagtacgatgggcgaacgagatgctgaactggcgacgattgaatttctgaaaacgtgggtgcctgcgggtaagtcgccgatttgcggtaacagcatcggtcaggatcgtcgttttctgtttaaatatatgccggaactggaggcctacttccactatcgctatctggatgtcagtacgctcaaggaactggcgcgccgctggaagccggagattctggccggctttaccaagcagggcacgcaccaggcgatggatgatattcgcgagtcggtggcggagctggcttactaccgcgagcatttcattaagctgtgaggcgtaacatgccggatggcaacgccagagcgtctcatccggcagctctccccacactgaattactgcgtaaaccatttctcctgcatctgcgcatattccggcgacgctttcaccttgtcgagcgcggcattaatttcttgcaatagcgcgtcgttgtctttgcgtaccgcaatgcctaacccttttccgtagtagtcaggatcgctggcgcgttcatccatgatggcgtaatccggattgttttttagccacttaccaatcgcggcgacatcgccaaacacgccctcaagacggttgtttttcagatcggtaaaggcgtttagatagctgtcataggcgacaggcgtgatagcttgttgtttatcctgcaaatagcgctgatgcgttgtaccgttttccagaccgacttttttgcctttcagatcggcaaaagtgtgataagcccctttacgcgtgacgactaccgccgatagaccttcgtaatagggttggctaaaggagacctgctgctcacgtttgggcgtcatatccataccggcgatcaccgcatcaaactttttgaagcgtaggctggggatcagactatcaaagctctggttagtgaatgagcactccgcttgcatctctttgcagaccgcgttggcgacatcaatatcgaaaccaacaattttattatcggcatcgacaaactcatagggcgcataggtggcggaggtgccaaaatgtaatgttctggcggaaacggaagcggcgtgaacggagaggctggctaacagcatgacaataagtttttttttcatcttgatccctgatatcaattggatgttgtggtcaccgtgctattctttttttggcgcagggtgctattctgattctgtgcctttaggcgtggcgtgaaaagttttttgttgcatagcgcacgctttgctcgttttttgtcttgtttggtgatttaatcagcattcaaacaaaaatcgcgaaaaaatgcgttcaggggcttgcagctaaatggatttctcgtataatgcgcctcccgtaacgacgcagaaatgcgaattacgacagcaacaaatttgcgggaatagctcagttggtagagcacgaccttgccaaggtcggggtcgcgagttcgagtctcgtttcccgctccaaaatttgaaagtacttgttaagtacaaaccaccaatcgcaggatttcgaattgcgacaaggcggcaactgaacgagtcctcaggagcttactgaagtaagtgactcaggcgagtgaaggcagccaacgcagtagcggttcgaaagacgaagattatgcgggaatagctcagttggtagagcacgaccttgccaaggtcggggtcgcgagttcgagtctcgtttcccgctccaaaatttgaaagtgcttgttaagcacagaccaccaatcgcaggatttcgaattgcgacaaggcggcaactgaatgagttctcaggagcttactgaagtaagtgactcaggcgagtgaaggcagccaacgcagtagcggttcgaaagacgaagattatgcgggaatagctcagttggtagagcacgaccttgccaaggtcggggtcgcgagttcgagtctcgtttcccgctccaattcttatctacagtaaaattatccacaacgaatatcgcgttggggcacgttttgttccgctttcgtcagatccttgtaaacagacttatccacagggcggcccattactcctggaatgcaaaaaattatacctgacgcgtagaatttctataatttactgaaaaatatagaaaaaataagatttcaaaacgttagctttattgactattccttttttccctcttgaatcgcaatgtgtttttatttttatacacagcctgtgaataattcaggcatcgcgcaccagccctttttcaatcaccctgaccagacgctgttttttcggtagctgcacttcaatgatgcaggcgttgcgcttttcaatttgttgcgcaatcgcccattcgatatgctcatcgagaagtggatgctcacccttgcggctttccagcgccgtaatgacggcattactccacggcgcattccccagcgcgacggcaacattgcgcagccagcgtaaatgaccaatgcgccgaatcgcagaaccttcagtgactttcagaaactgcgcttcgctccagctaaacaactcaagcaaatctggattatgcagcgccttgcgtgggctaaaatctgcttcgtcggtcaactgagagtaacgattccacggacagataagctggcagtcatcgcagccgtaaatacggttacctatcagtgggcgaaatgcttccggaatagcgccttccagctcaatggtgagataagaaatacagcgccgcgcgtccaccgtatacggttcgacgatcgccccggtcgggcaaatggtcatacaggcgacgcatttaccgcaaccttcctcgaccggctggtcgaccggcagcggtaaatcaatcagcaattcccccaggaaaaagaatgagcccgcctcccgattaaggataagtgagtgcttacccgtccagccaagtccggctttttccgctaatgggcgttcaagaataggcgcagagtcgacaaacggtctaaaattcagcgaaccgcagtactgctggatctgctcgcccagttttttaaggcggctgcgtaatagcttgtgataatcacgccccagcgcatatcggctaacgtagcccagcgtgggatccttcaacgtactggcaaacgcggcgttggcgggcagatagttcatgcgcacgctgatgacacgtagcgtaccgggtaagagttcatgaggccgggcgcgcatcataccgtggcgcgccatccatgccatctcgccgtggtattgtttgtccagccacgcctgcagcgcaggttcggatgcgcgcagatcggtatcagtaataccgacctgctgaaagcccagctccagcccccactgcttaatattttgcgctaactgattgagatcgaggggctttgacatgatggaccataacatgaagaaaaaccctgtaagtataccacactccatttggcccgccgatgacatcaaacggctggaacgcgatgcggcggatgccttcggactcacactctatgaattgatgctgcgcgctggcgacgcggcatttcgggtagcccgtgacagttatcctgacacccgacactggctggtgttgtgtggtcatggcaacaacggcggcgatggttacgtcgtggcgcgactagcgcaagcggcgggcattagcgtaacgttgctggcgcaggagagcgacaaaccgttgcctgaagaagcggcgcaggcgcgcgatgcctggctgaatgccggcggcatcatccatgctgccgatattatctggccggaagcgacggatctgattatcgacgcgctgcttggcaccggcatagcccaggcaccgcgcgacccggtagccggtctgattgaacaggcgaacgcccatcctgcgccggttgtcgccgtcgatatcccgtcaggtctgctggcgcaaacgggcgccacgcctggcgcggtgataagcgccgcgcatacggtcacgtttatcgccctgaaaccaggcctgctgaccggcaaagcgcgtgacgttaccggcatattgcattatgacgcgttgggactggaaggctggctggcgagccagacgccgccgctccggcgttttgacgcgacgcagttggggcaatggctaacgccgcgtcgaccgacctcgcataagggcgatcatggtcgtctggcgattattggcggtgaccagggaacagcgggcgcaattcggatggctggcgaggcggcgctgcgtacgggggctgggttggtcagagtactgactcgcggtgaaaacatcgcgccgttgctgacggcccgcccggaactgatggtacatgaactcacgcctcagtcgctggaagagagcctgacctgggctgacgttgtggtgatcggcccggggcttggacagcaggaatggggcaaaaaagccttacagaaagtagaaaacgtccgtaaacctatgctgtgggatgcggatgcgttgaacctactggcaatcaatcctgataaacgtcacaatcgcgtgattacgccgcatccgggagaggcggcccgcctgttaggatgttctgtggcagaaattgaaagtgatcgcttactttcagcacagcgtctggtaaaacggtatggaggcgtggtcgtgttaaaaggcgcaggaacgattatcgccgctgaacaccaccctctggctatcattgacgctggtaatgcggggatggcgagcggcgggatgggcgatgtcctgtccggcatcatcggtgcattgctcggacagaagtttaccccgtatgatgcggcatgtgtgggatgtgtggctcacggcgcggcggcggacttactggcagcgcgttatggcgctcgcggcatgttggcgaccgatctttttactacgctgcggcgtattgttaaccctgatgtgattgacgtaaaccatgatgaatcgagtaattccgctacctgacgaacaggcgacgctagacctggggcaacgggtagccaacgcctgcgatggcgcgaccgttatttatctgtatggcgatttaggtgccggtaaaacgacgtttagccggggatttttacaggcgttaggccataacggtaatgtaaaaagccccacctatacgctggtagagccttatgcgattgataacatgatggtatatcacttcgacttataccgtcttgcggacccggaggagctggagtttatgggcattcgcgattatttcgccaacgacgccatttgtctggttgagtggccgcaacaaggtaaaggcgttctccccgacccggacgtcgaaatccatattgattaccaggcgcaggggcgtgaggctcgcgtaagcgcggtatcctcatcgggtcattcgttactggcgcgtttagccgattagctataaaggtggcgggatgatttatcgcatcaaaaatgccgtaatagcagccttaatcctgctgtgcgcgcaggcgggcgccgccagtctctctgatattcaggtgtccaacggcgagcagcaggcgcgcattacgctgagttttatcggcgagccggaatatgcttactcacaggacggtaaacggactgtggcgctggatatcaggcagaccggcgtgattcaggggctgccgcttcagtttagcggtaacaatctggtaaaaacgatccgtgctggaacgccgaaagatgcgcaatctttacggttgcttgtcgatctgacggaaaatggtaaaaccgaggcggtgaagcggcaaaacggcggcaactatacggtcattttcaccattaatgccgatgttccgccgccaccgccgcctgtcgtcgcgaaacgggttgaaagcgcgcctcgcccgacggagccggcccgtaatccgtttaaatcttctgatgatcgcctgaccggcgtaaccagcagcaataccgttacgcggcctgcggcgcgcgcgtcggcaggcgctggcgataaagtggtgattgctattgatgccggacatggaggccaggaccccggcgcgataggcccgggcggtacgcgcgagaaaaatgtcaccatcgccatcgcgcgtaagttacgcacattactgaataacgatccgatgtttaaaggcgtgctgacgcgtgacggcgactattttatttcggtgatggggcggtctgatgtggcgcgtaagcaaaacgccaactttcttgtctctattcatgcggatgccgcgccaaatcgcgacgccaccggcgcctccgtctgggtattgtccaatcgtcgcgcgaacagcgaaatggcaaactggcttgagcagcatgagaagcaatccgaactgttaggcggcgctggcgatgtgctggcgaacagtcagtcagacccttacctgagccaggcggtactggatttgcaattcggtcattcgcagcgggtagggtatgatgtggcgacgaacgtactaagccaactcgacggcgtggggtcgctgcataaacgccgcccggaacacgctagcctgggcgtgttgcgttcgccggatatcccgtccattttggtggagacgggctttatcagtaatcacggcgaagagcgattgctggcgagcgaccgctatcagcagcagattgctgacgctatataccgggggttgcgtaagtactttgcagcgcatccgatccagtctgcgccgcagggcggcccaggccagacggccagtaccaaccagcctggcgccataaccgccgcgaattaaggagatttcatgccgattcaggttctgccgccgcagcttgcgaaccaaatcgccgctggcgaagtggtggaacgccctgcgtcggttgttaaagagctggtagagaatagtctggatgcaggcgccacccgcgttgatatcgacatcgagcgtggcggcgcgaagcttattcgtattcgcgacaatggctgcggcattaaaaaagaggagctggcgctggcgctggcccgtcatgccaccagtaaaatcgcctcgcttgacgatctggaagcgattatcagtctgggatttcgcggcgaagcgctggccagtatcagttcggtctcgcgtttgacgctaacgtcgcgcacggcggagcaggcggaagcctggcaggcgtatgcggaagggcgcgatatggacgtgacggtaaaacccgccgcgcacccggtcggcaccaccctggaagttctggatctcttttacaatacgcccgcccggcgcaaattcatgcgtaccgaaaaaacggaatttaatcacatcgatgagatcatccgtcgtattgcattggcccgttttgacgtcacgcttaacctgtcgcacaacggcaaattggtacggcagtatcgcgctgtcgcaaaggacgggcaaaaagagcgccggttaggcgccatctgcggcacgccgtttctcgaacaggcactggcgatcgagtggcagcatggcgatctgaccctgcgcggctgggtcgccgatccgaatcacaccaccacggcgttaacggagatccagtactgttatgtgaatggccgcatgatgcgcgaccgcttgatcaaccatgccattcgccaggcctgtgaagataaactgggcgcggaccaacagcctgcgtttgtgctgtatctggagattgacccgcatcaggtggatgtcaatgttcatcccgccaagcacgaagtgcgttttcatcaatcccggctggtgcacgacttcatctatcaaggggtgctgagcgttctgcaacagcagacggaaacggcgctgccgctggaggagattgcgccagcgccgcggcatgtccaggaaaaccgtatcgccgccgggcgcaaccattttgctgtacccgccgagccaactgcggcgcgcgagcccgcgacaccgcgttattccggcggcgcatcgggcggtaacggcgggcgtcagtccgcaggtggttggccgcacgcgcagccaggttatcagaagcagcagggcgaggtttatcgcacgcttttacagacgccgacggcgagccccgcgccggagtcggttacgcctgcgcttgacggacatagccagagtttcggtcgcgtactgacaatagtcggcggtgactgcgcgttgctggaacacgcggggactatccagctcttgtcgctaccggttgcggagcgttggctgcgtcaggcgcagcttacaccgggtcaaagtccggtttgcgcgcagccgttgctgattccgctgcgtttaaaagtgagcgccgatgaaaaagccgcgctgcaaaaagcccaatctttgttgggagaattgggtattgaatttcagtcagatgcgcagcatgtgaccattcgggcggtgcctttacccttacgacaacaaaatttacaaatcttgattcctgaactgataggctacctggcgcaacagaccacatttgcaacggtcaatattgcacaatggatagcgcgtaatgtgcagagcgaacatccgcagtggtcgatggcgcaggccatatcgctgctggcggatgttgagcggctatgtccgcagctggtaaaagcgccgccgggtggcctgttacaacctgttgatttacattcggcgatgaacgccctgaagcatgaatgatgtaagcaaggcgagcctgcctaaggcgatatttttgatggggccgacggcctccggcaaaacggcgctggcgatagaactgcgtaaagttttgccagtagagttgataagcgttgattccgccctcatttatcggggaatggatattggcacggctaagccgaatgccgatgagctgaaagcggcgccgcatcgactgttggatatacgcgacccgtcgcaggcgtattcggcggcggattttcgccgcgacgcgttagcgcaaatggcggagatcaccgctgcggggcgtatcccgctgttagtgggcggtaccatgctgtattttaaggcattgctggaagggttatcgccgctgccttcagcagatccggaagtcagatcccggatagagcagcaagcagcggagcttggatgggaggcgttgcatcagcaacttcaggagatagatccggttgccgccgcgcgaattcatccaaatgatccgcaaagactttcccgggcactggaagtttttttcatttcgggtaaaactttaacggagctaacgcaaacgtcaggagacgcgctaccgtaccaggtgcatcagttcgctatcgccccggcgagccgtgaactgctccatcagcgcattgaactgcgttttcatcagatgttggcttcaggttttgaagcagaagtccgggcgctttttgcccgaggagatttgcatacggacttgccttccatccgttgtgtgggataccgccagatgtggtcatacattgagggcgaaatctcatatgatgaaatggtttatagaggtgtttgcgccacgagacagttggcgaagcgccagatgacctggttgcgcggttgggaaggggtgcgctggcttgacagtgagaatcccgatcgggcgcgaaaagaagtattacaggttgttggtgctatcgcagactgaatgtgtacaattgagacgtatcgtgcgcaatttttcagaatcgaaaggttcaaagtacaaataagcatataaggaaaagagaatggctaaggggcaatctttacaagatccgttcctgaacgcattgcgtcgggaacgtgttccagtttctatttatttggtgaatggtattaagctgcaaggtcaaatcgagtcctttgatcagttcgtgatcctgttgaagaacacggtcagccagatggtttataagcacgcgatttctactgttgtcccgtctcgcccggtttcccatcacagcaacaatgccggtggcggcgccagcaataactaccatcacggtagcaacgcgcaggggtctactgcgcaacaggacagcgaagagactgaataagttcacgcgctgtttatccatgtcgggggcgtcggataatcgcccccgctggttattaagagggtttacgcttgtttgaccgttatgatgccggtgagcaggcggtactggtacacatctatttttcgcaagacaaagatatggaagacctccaggagtttgaatctctggtctcttccgccggtgtcgaagcaatgcaggtgattaccggtagccgtaaagcaccgcacccgaagtactttgtaggtgaaggtaaggcagttgaaattgcggaagccgtgaaagcgactggcgcagcggtcgtattgtttgatcatgcattgagtccagcccaggagcgaaacctggagcgtttgtgcgagtgccgggttatcgatcgcaccggtcttatcttagatatttttgcccaacgtgctcgtacccatgaaggtaagttgcaggttgagctggcgcagctacgccatctggctacgcgtctggtgcgtggctggacccaccttgaacgtcagaaaggcgggattggtttgcgcggtccgggtgaaacccagctcgaaaccgaccgtcgtttactgcgtaatcgcattgtgcagattcagtcgcgcctggagaaagttgagaagcaacgtgagcaggggcggcagtcgcgcatcaaggccgacgttccgacggtatcgctggtgggctataccaacgccggaaaatccaccctttttaatcagatcactgaagcgcgggtctatgcggcagatcagctatttgcgacgctggaccccacattacgtcgtattgatgtagcggatgtcggtgaaaccgttctggcggatacggtaggctttatccgccatttaccgcacgatctggtggctgcctttaaagctaccctgcaggagacgcgtcaggcgacgctgctgctgcatgtggtcgatgcggcggatgttcgtgtgcaggaaaacatcgaggcggtaaacaccgttcttgaagagattgacgctcacgaaatccccaccttaatggtgatgaacaaaatcgatatgctggacgactttgaaccgcgtatcgacagagatgaagagaataaacccatccgcgtttggctttcagcgcaaagcggcgtgggaataccacagctttttcaggctttgacggagcgtctttccggcgaggtggcgcagcatacgctgcgtttgccgccgcaggaagggcgtctgagaagccggttttatcagcttcaggcaatagaaaaagagtggatggaggaagacggtagcgtcagtctgcaggtacgaatgccgattgtcgactggcgtcgcctctgtaaacaagaaccggcgttgatcgaatacgtgatctagacgcgaagtcattcaggtcgtattgaggcggtagctgagagaatctcaggagctcacaacgaagtgacctggggtaaaaaagccgccactcaagacgcagcctgaaagatgatgtctgtaacggcggttcgtctgaagcatggagtaatttcgccttatcctctgaggtcgaaagacaacggggatcaccgcataacaaatatggagcacaaacatggcgtggaatcagcccggtaataacggacaggaccgcgacccgtggggaagcagcaaacctggcagcaactctgggggaaatggaaacaaaggtggccgcgatcagggacctcccgatctggatgatatcttccgtaagctgagtaaaaaactcggtggttttgggggcggtaaaggcaccggttccggcggcggtagctcatcgcaaggcccacgtccgcaactgggaggccgtattgtcgccatcgccgcggcggcagtagtcattatctgggcggccagcggtttttataccattaaagaagccgagcgcggcgttgtgacgcgttttggtaaattcagccatctggtagagccaggtctgaactggaagccgacatttattgacgacgtcacgccggtgaacgtcgaagcggtgcgcgaactggcggcgtcaggcgtgatgctgacgtctgatgaaaacgtcgtgcgcgttgaaatgaacgtgcaataccgcgtcaccgatccgcagaaatatctgtttagcgtgaccagcccggacgatagcctgcgtcaggccaccgacagcgcgctgcgtggcgtcattggtaaatacacgatggatcgcatcctgaccgaaggtcgtaccgttattcgtagcgatacccaacgcgagctggaagagactatcaaaccgtacaacatggggattaccctgctggacgtgaacttccaggctgcgcgcccgccggaagaggtgaaagccgcctttgacgacgcgattgccgcacgtgaaaacgagcagcagtacattcgtgaagcggaagcgtataccaacgaagttcagccgcgcgccaacggtcaggcgcagcgtattctggaagaggcacgcgcctataaaacccagactatcctggaagcgcagggtgaagtcgcccggtttgcgaagattttgccggaatataaagccgcgccgcagattacacgcgagcgtctgtatattgaaacgatggaaaaagtgctgagccatacccgtaaagtactggttaacgacaagagcggtaatttaatggtgctgccgttagatcagatgctgaaaggcgggaatgcgccggcggcaaagagcgacaatagcgccagcaacctgctgcgcctgccgccgtccacaaagtctaacgccagcggagcaagcaacacgtcgtcctcaaatcagggcgatattatggaccaacgccgcgcgaatgcgcagcgtaacgactaccagcgtcagggggaataacgatgcgtaagtcagttattgcgattatcatcatcgtgctggtagtgctctacatgtccgtctttgtggtcaaagagggcgagcgcggcattacgctgcgttttggtaaagttctgcgtgacgatgagaacaaaccgctggtttacgcgccgggtctgcactttaagatcccgtttattgaatcagtgaaaatgcttgatgcgcgtatccagacgatggataaccaggccgatcgctttgtgactaaagagaagaaagacctgattgtcgactcctacatcaaatggcgtatcagcgactttagccgttactatctggcgaccggcggcggcgatatttcgcaagccgaagtgctgttaaaacgtaagttctcggaccgtttgcgttctgagattggtcgcctggacgtaaaagacatcgtgaccgattctcgtggtcgtctgactctggaggtgcgcgacgcgctgaactccggttcagccggtaccgatgatgaagtagcgaccccggcggcggatgacgcgattgccgaagcggcggaacgcgtcacggcggaaaccaaaggtaaagtaccggtcatcaacccgaacagtatggcggcgttgggtatcgaagtggtcgatgtgcgtattaagcagatcaacctgccgaccgaggtttctgaggcgatttacaaccgtatgcgcgccgagcgtgaagcggtcgcgcgtcgtcatcgctcacaaggtcaggaagaagcggaaaaactgcgtgcggctgctgactatgaggtgacgaaaactctggcggaagccgagcgtcaggggcgtatcatgcgtggtgaaggtgatgctgaagccgcgaagctgtttgccgacgcgttcagccaggaccctgatttctacgcgttcattcgtagtctgcgcgcttacgagaagagcttcgaaggtaatcaggacgtgatggtactgagcccggacagcgatttcttccgctacatgaagacaccgagttcgacgacacgctaaaatagcgtcagcggttttagaccagcaaaaccaccgcatccaaaggatgccggtggttttcttttataagggcgataaatgaattcaacaatctggttggcgcttgctctggtattagtcctcgaagggctgggaccgatgctgtatcccggcgcatggaaaaaaatggtttcggcactggcgcaactgccggaaaatgttttacgtcgttttggcggcggacttgtggtcgcgggagttgtggtctactacatgttgaggaaaacgattggctgagcaaaaagtggtcggatttgccgcagattgagtgcaaaaagtgctgtatatctgaaaaagcgatggtagaatccatttttaagcaaacggtgattttgaaaaatgggtaacaacgtcgtcgtactgggcacccaatggggtgacgaaggtaaaggaaagatcgtcgatcttctgactgaacgggctaaatatgttgtacgctaccagggcggtcacaacgcaggccatactctcgtaatcaacggtgaaaaaaccgttctccatcttattccatcaggtattcttcgcgagaatgtaaccagcatcatcggtaacggtgttgtgctgtctccgagcgcgctgatgaaagagatgaaagaactggaagaccgtggcatccccgttcgtgagcgtctgctgctgtctgaagcctgtccgctgatccttgattatcacgttgcgctggataacgcgcgtgagaaagcgcgtggcgcgaaagcgatcggcaccaccgggcgtggaatcgggcctgcttatgaagataaagtggcacgtcgcggtctgcgtgttggtgaccttttcgacaaagaaaccttcgctgaaaaactgaaagaagtgatggaatatcacaacttccagttggttaactactacaaagctgaagcggttgattaccagaaagttctggatgatacgatggctgttgccgacatcctgacttctatggttgttgacgtttcggacctgctcgaccaggcgcgtcagcgtggcgatttcgtcatgtttgaaggtgcgcagggtaccctgctggatatcgaccacggtacttatccgtacgtaacttcttctaacaccactgcaggtggcgtggcgaccggttccggcctgggcccgcgttatgttgattacgttctgggtatcctcaaagcttactccactcgcgtaggtgcgggtccgttcccgaccgaactgtttgatgaaaccggcgagttcctctgcaagcagggtaacgaatatggcgctactaccggccgtcgtcgtcgtaccggctggctggacaccgttgccgttcgtcgtgcggtacagctgaactccctgtctggcttctgcctgaccaaactggacgtgctggatggcctgaaagaggtgaaactctgcgtggcttaccgtatgccggatggtcgcgaagtgactaccactccgctggcagctgacgactggaaaggtgtagagccgatttacgaaaccatgccgggctggtctgaatccaccttcggcgtgaaagatcgtagcggtctgccgcaggcggcgctgaactacatcaagcgtattgaagaactgaccggcgtgccgattgatattatttctaccggccccgatcgtactgagacgatgattctgcgcgacccgttcgacgcgtaaatctggtacgcctggcagatattttgcttgccgggctaacagtgtgatacattgctgtgtcgggtaagccattacgctatccgacacagtgttaaatcctcgcttttttccttccccgaactgaaataaattagcgacacagcttgtggctggtttatcatcaatataaatgtatttttcccgttttcccttttcctgaggttgatgtgcagttaacgagtttcaccgattacggcttacgtgcgctaatctatatggcgtcgttaccagatggacgaatgaccagcatttctgaggtgacagaagtctacggcgtgtcccgtaatcatatggtcaaaattatcaatcagcttagccgggcgggctttgtcaccgccgttcggggaaaaaatggcggtatccgcctgggtaaaccggctaatactatttgtattggcgatgtggtgcgtgagctggaacccttatcactggtcaactgtagcagcgaattttgccacatcacccctgcctgtcgtctgaaacaggcgctttctaaggccgtgcagagttttctcaaggagctggataactacacgcttgccgatttggttgaagagaatcaaccgctttataaattattactggtggagtgaagtaaacttcattagagatgacaatggaggaacctcaatgtcacaagatcctttccaggaacgcgaagcagaaaaatacgcgaatcctatcccgagccgggaatttatcctcgaacatttaacgaaacgtgaaaaaccggccagtcgcgaagaactggccgtagaactgaatattgaaggcgaagagcagcttgaagccttgcgtcgccgcctgcgcgcgatggagcgcgacggacaactggtctttacccgccgccagtgctatgcgctgccggaacgcctcgacctgctgaaaggcaccgtgatcggtcatcgtgatggttacggtttcttacgtgtcgaaggccgcaaagacgatctgtatctttccagcgagcaaatgaaaacctgtattcatggcgatcaggtgctggcgcagccgctgggcgccgatcgtaaaggtcgccgcgaagcgcgtatcgtccgtgtactggtaccgaaaaccagtcagatagtcgggcgttatttcaccgatgcgggcgtcggctttgtggtgccggacgacagccgcctaagcttcgacattcttatcccgccagaagacgtcatgggcgcgcggatggggttcgtggtcgtggttgaactgacccaacgtccaactcgccgtactaaagcggtagggaaaatcgtcgaagtgctgggcgacaatatgggcaccggtatggcggttgatatggcgctgcgtacccatgaaataccttacatctggccgcaggcggtagagcagcaggtcgccgggctgaaagaagaggtgccggaagaggcgaaagtcggtcgtgtcgatctgcgcgatttgccgctggtcactattgatggcgaagatgcccgtgactttgacgacgcggtttactgtgagaaaaaacgcggcggcggctggcgtttgtgggtcgctattgctgacgtgagctattatgtacggccgccaacgccgctggatcgcgaggcgcgcaatcgcggcacgtcggtttacttcccgtcacaggttgtcccaatgttgccggaggtgctctccaacggtctgtgttcgctaaacccgcaggttgacaggctgtgtatggtctgtgaaatgaccatctcggcgaaaggtcggctgaccggctacaaattctatgaagcggtgatgagctcccatgcgcgtctgacctataccaaagtctggcatatgctgcagggcgatcaggatctgcgtgaacaatatgcgccgctggtgaagcatattgaagagctgcacaacctctacaaagtgctggataaagcgcgtgaagagcgcggggggatctcgtttgagagcgaagaggcgaagtttatctttaacgccgaacgtcgcattgagcgtatcgaacagacccagcgtaatgacgcgcataagcttatcgaagagtgcatgatcatggcgaatatctcggcggcgcgctttgtcgaaaaagctaaagagccggcgttattccgtattcatgataagcccaccaccgaagcgatcacctcattccgctccgtactggcggagctggggttggagctgccgggcggaaacaaaccggaaccgcgcgattatgccgaactgcttgaatcgattgccgaccggccggacgccgaaatgctgcaaactatgctgctgcgttcaatgaagcaggcgatttacgatccggaaaaccgcgggcactttggcctggcgttgcagtcttatgcgcactttacctcgccgattcgccgctatccggatctttctttgcaccgcgccattaagtacctgctggcgaaagagcaagggaacaagggcaacaccacagaaacgggcggttatcactactcgatggaagagatgttgcagctcggtcagcactgttcgatggcggaacgccgcgctgatgaagcgacgcgtgatgtctccgactggctgaaatgtgactttatgctggatcaggtaggcaacgtctttaagggcgtgattgccagcgtcaccggtttcggcttctttgtccgtcttgatgaactgtttatcgatgggctggtacacgtttcctcactggataacgattactatcgcttcgatcaggtagggcaacgtctgattggcgagtccggcgggcagacatatcgcctgggcgaccgggtcgaggtacgcgtcgaagcggtgaatatggacgaacggaaaattgactttagcctgatctccagcgagcgcgcaccgcgtaacgtcggcaaaacggcgcgtgaaaaagcgaaaaaaggtgaaagtaaaaacgccggtaaacgtcgtcaggtaggtaaaaaagttaacttcgagcctgatagcgccttccgcggcgagaaaaaagcgaagccgaaagcagcgaagaaagacgcgagaaaagcaaaaaagccatcggctaaaacgcagaaaatagccgcagcgaccaaagcgaagcgtgcggcgaagaaaaaagcggcagagtgagcaataccctcttcaaacagaagagggtcaattatctgtaggccgggcaagcgtagcgcccccggcaaaacgtaaacaacgagtacattaatgagcgaaatgatttacggcatccacgcagtgcaggccctgctggagcgcgcccctgaacgttttcaggaagtctttattttaaaaggccgtgaagataaacgtctgttgccgctgatccacgcccttgagtcccagggcgtggttatccagctggcaaaccgccaatatctcgacgagaaaagcgacggtgccgtgcatcagggtattatcgctcgcgtgaaaccaggccggcagtatcaggaaaacgatctgccggatctgatcgcattacacgatcgcccttttttgttgatcctcgatggcgtcaccgatccgcataatcttggcgcctgtctgcgcagcgccgatgctgcaggcgtacatgcggtaatcgtgccgaaagaccgctccgcgcaacttaacgcgacggcgaagaaagtcgcctgcggcgcagcggaaagcgtgccgttgatccgcgtcaccaacctggcgcgcacgatgcgcatgttgcaggaagagaatatctggattgtcggaacggcgggcgaggctgaccatacgctgtatcagagcaaaatgcctggccgcatggcgctggtcatgggcgcagaaggtgaaggtatgcgtcgtctgacccgtgagcactgcgatgagctgatcagcattcctatggccggtagcgtgtcgtcgctgaatgtctctgtggcgaccgggatttgtctgtttgaagccgttcgccagcgcacctgatgctgatagtattttttaagaaaaaaccatccataatcggatggtttttttttatctttgactggtaatataaaaaacaaaacctaccctgtaatttcttttatttataaaaatgagatagagataaaaatatggcatggactccacggacgctggcggatgcattaaacaacatcgccgaattagatattgatatagaaaataatgaatcttcattaataataaaaatgaatgattatggcgatttaccactggcggttttatttacctcgcaacaaatagttatcgagacttatatctgtccggtaaatacgattagagataccgcggaatttaatcttttcttgctgagaaatcagaaggttttaccgctgtcttcggtcggtattacccaggtaaaacaggaggaatattatgtcgcttttggcgcgctgtcgttaaattcgtcgcttgccgacgtgatgctggaaatcaccacgcttgtagaaaatgcgttggatatcgctgaaataacacaagtctattcacaggaataatacaggcggcttacatgggaattttaaaaagtttgttcacgttaggtaaatcattcgttgctcaggcagaggaagccattgatgaagcacagggtgtacgtatgctggagcagcatattcgcgacgcaaaagccgagctggataaagcgggtaaatccagagtggatttattggcgcgggtgaagctaagccatgacaagctgaatgatttacgtgagcgtaaagccagccttgaaacacgggcgttggcggcaatgagtaagaatgtcgacgccgctttactcaacgaagtggcggaagaaatagcccgtctggaaaatgccattcttgccgaagaacaggtgctgactaatctggaagcctctcgcgatgcggtggagaaggccgtaacggcgacaggccagcggattgcgcagtttgagcagcaacttgaagtggttaaggcgacagaagccatgcagcgcgcgcagcaggcggtgacgacctcgaccgtcggagccgcgtcgaatgtgtctacggcggcggagtcgcttaaacgtttacaaacgcgtcaggctgaacgccaggcccggctggatgccgccgcgcagctggaaaaagtcgccgatggacgcgacctggatgaaaaactggcgcaggccggtattggcgcaaccaataaaagcaatgctcagggtgtgttggcgcgtttacagcgtcaacaaggcgaataatgctctttacgtggattgtcaaaacctgccagcgtcatttgtccagactgacctggcccgctttgctgggcctgtttatcgggcagtatctgctttgttatctggtgctgcgcctgttgcgcgaaagcgcgttggtgagccagttaagcgattttatctattactgctcggtggtgggttccacattaggttttggcgatcttagcccgcagacggcgccaggacgtctgttcaccgcgctgtggcaaattccggttagcgtcgggttgttcggcgcgttaatgggaaaagtgattgcgcaggtacagggaatgttagcgaaaggaataacgggcatgggcgattatcgccatttacaccatcatatgctggtgattggctggcggggtcatcaaaccgaaaagatgatctcattgctgctatatgacaagcggcgtgcctttgaacgggttctgctgtgcgaactggaagatattcagcatccgctgccgggtaataactgggtggattttatccgcatcagcaactttaacgatccgcaggaacaccagcgcatggggctggagcagtgccagagcgtgattattttcgctcgtaccgatgagcagaccttcacggcggcgctctcgctggcagactatgtacccgcgcagtgccatattgtggtttatctggaagacgagcgttatgccggattactggaaacccactgcccgcgcatggagatagtccgtaacctttccgctgaacaactttcccgttccattcaggacccaggatcatcgcaatctgtcgcttccattatgaatccgatgctgggcgataccggattcgcgctgcctgtcccggcttctgtcgcgcctatgcgatacggcgcgctaatgcgttatatgaagcttcatcatgacgcgacggtgctggggatcagtcactgcaagaatggtcgtggtatggaattgaatccggtgatttcaactgaagtcagaggcggtatgtggctacatctggtcggtaataatcgcattctggctgaagaggtcgcatggcaagagatagaggttcccctatgatgcaattttttcagcgtttgctcggtaaaacaagcgcgccagcgccgattcgcggaccattaggattacatcttaacgccggtttcacgctggatacgctggcatttcggctactggagtcgtcgttgctggtggcgctaccgggtgaaaaatacactgtcgcggcagcgagtcgcatagatttaggcggcggcagtcagatttttcgctactacacctctggcgatgagtttctacaaattaacaccactggcggcacggatgttgacgacattgatgacatcaaactttttgtatatgaggaaagtttcggtattaacgaggaacgtcactggcgttcagccattgcgccagcggcaatagggccgatgacgctcaactggcaagaacggcgctggcagcgcttttttaaccatgaagagccgggcaatattgaacctgtctacatgctggaaaaggttgaaaatcagcaggcagagaaatgggacgttcacaattttacgatgggcttccagcgccaggtgacggatgacgcctgggagtatcttctattgaacggggaagaatcatttaatgagcgcggtgagcctgaatgggtgttttcacgcgccctcggcgtggatatcccgctcacttcactgacggttattggttaagcacatacagggaaattatgcatatactggacgcattactggctttctgcgcctatttttttattggcgcggcaatggtcattgtatttctttttatttactcaaagataacgccgcataatgaatggcagttgataaaaaataacaatactgcggcatcgctggcctttagcggtacgttgctgggctatgtcatccccttatccagcgcggcgataaactcggtcagtatcccggactattttgcctggggcggcattgcgctggtgattcaactgctgatttatggttgcgtaaggttatacatgcctacgctgagcgaaaaaattattcatcacaacgtggcggcggggctatttatgggaaccgcagcgctggctggcggtatttttaacgctgcctgtatgacatggtaacggaagatcatggcaaaaaaacgaaaatccagaagcacatccggcgtaggccattcggcaataagacgaatagccgaaccggtcaatccctttgagcggcaacgaaatcgctacacgccaaaatgcctgacgctggcgattatgggtggagcggccttttttctcctgaaagggtgcggtgatggcggcaatagtgacaacgacggcgatgggacgttttacgccacggtgaacgactgtattgacgatggcaatagcgccagcgtttgcgctgacggctggaataatgcgaaaacagaattttacgctaatgtgcctaagcaattgacgcaggagcgctgtcagacgcagtttggcgattgctactttgatattaccgagcggagctgggttccggtattaagcggctttttactcagccgcgcgattcgtcagaaccgtgatgaacaatacatctatagcagcggcggttcatcttatgtctcccgtcccgtctggcgcaccacatccggcgactatgcgtggcgcagcggcacagggaaaagcgataccgcgaccagccctggttatatcacacggaaagcgtccaccgtctcccgcggcggctatggccgttcttccagcgcccgcgggcactggggaggctaaccatgctacgacacaacgtaccgatacgtcgggatctggataagatcgcctgcgatcacggttttgactttcatgttatcgataacgaaatttactgggatgaaagccgggcctaccgttttacattacggcaaattgaagaacagatcgaaaaaccgaccgcagagcttcatcagatgtgtctggagattgtcgagcgggccgtccgggatgagcagagcatgcagcagctggcgatcccgccattgtactgggatgtcatcgccgaaagttggcgcagccgcgatccttcgctttacgggcggatggatttcgtctggtgcggcaaagatccggttaaattgctggaatacaatgcggatacgccgacgtcgctctatgagtcctcctactttcaatggctatggctggaggatgcccgtcgtagcggcgccatcccgcgtgatgccgatcaatacaacgcgatacaggagcggctgatcgcccgcttcagcgagctgtacagtcgggaaccgctctacttttgctgttgtgaagataccgacgaagatcgcacgacggtgctgtaccttcaggattgcgcgcagcaggcggggcaggaaacgcgatttatctatattgaagaactggggcttggcgtaggcggcgtgctgaccgatctggacgataacgtgattcgccgcgcctttaagctctacccgctggaatggatgatgcgcgatgacaacggcccgctgttgcgaaaacgtcgtgagcaatggattgagccattgtggaaaagtattctgagtaacaaagggctgttgccgttattgtggcgctttttccctggccatccgaatcttctgccggcctggtttgagggcgaaaaatcgctcgcagcgccaggcgaaagcagcgtacggaagccgatttattcacgtgaaggcggcaacgtcacgattttcgacgagcggcaaaatgttatcgatcatgccgacggcgactacgctgacgagccgatgatttaccaggcgtttcagcctttgccgcgctttggcgatagctatacgctgattggcagttggatcattgacgatgaagcctccgggatggggattcgcgaggacaatacgctaattaccaaagacacttcccgtttcgtcccacattatattgccggttaatcatacttttgtgatcttgctccggcgtcaatggcgcagtcatgaccatacttgacttcagcgccattgaaggagggagacaccatgtcctggcaaacacataccgtctttaatcaacctgctccgctcaataacagtaacttattcctgtctgatggcgcgctgtgtgaagcggtttcccgggaaggcgcgggatgggatagcgatcttctcgccagcattggccaacaactgggaacggcagaatcactggaactggggcgtctggcgaacgcgcatcctcctgagttgctgcgttacgatccccagggacagcgtttggatgacgttcgctttcatcccgcctggcacctgttgatgcaggggctttgcgctaatcgggtacataacctggcctgggaggaggaggcaagggcgggaagttttgtcgcccgggcggcgcgttttgtattacatgctcaggtagaagcgggaacactctgtcctgtcacgatgacctttgccgcgacaccgttgctattgcagatgcttcccgccactttccatgactggctggcgccgctgcgcagcgatcgctacgattcgcatttgctgccgggcgggcaaaagcggggtctgctcatcggcatgggaatgacggaaaagcagggcggatcggacgtactcagtaatacgacccacgcggagcggctggcggatgattcatatcggctggtgggacataaatggtttttctctgtgccgcaaagtgatgcgcacctcgtgttggcgcaggcaaaaggaggactatcctgtttctttgtgccgcgtttcctgccagacgggcaacggaactctgttcgtcttgaacgcctgaaagataaactcggtaatcgatctaatgccagcgccgaagtcgagtttcaggatgctatcggctggcggctgggagaagagggcgaagggattcggcatatcttaaagatgggcggtatgacgcgtcttgactgcgcgctcgggagtcatggcttaatgcggcgcgcattttcagtcgccatttaccatgctcatcagcgtcaggcttttggtaagccgctgatcgatcaaccgttgatgcgacaaaccttaagtcgtatggcgctatgcctggaggggcagacggcgcttttgtttcggctggcgcgcgcctgggagcaacgtcgcgaggcgaaagaggcattatgggcgcgattattcacgccagcggcgaaattcgccatctgtaagctgggaatcccttttgtggctgaggcgatggaggttctcggcgggatggggtattgcgaagagagcgaactcccgcgcctgtaccgtgaaatgccggtgaacagtatctgggaaggttccggcaatatcatgtgtctggatgtactgcgggtgctgacaaaacaacacggcgtctatgacgtattgagtgaagcttttgcggaagtcaaaggtcaggatcgccattacgaccgcgcggtacgtcagctacagcaacgtttacgcaaaccggacgaagcaatgggcagagagattacgcagcagcttttcttgctggggtgcggagcggaaatgctgcgtcatgcctcgccgccgctggcgcaagcgtggtgtcagatgatgctggatacacgcggcgaaatgccgctgcctgcccaggtgcaaaatgatttactgttaagggcgaccgggggactgcggtaacgtttgacctgtagtacatgccatccggcgcgagccacgcggcatcaggcatagagtatcgcctgtacgcgccagttatccgactgttgttcttcatacatttgaataattctgtaccaggacgcaccctgttcatcggctttcagggcgataatccgctctacatcctgtgggtttcctgcaacattactgaccgagatcaggccgatttcattcagacccgttacgcagtcagcactggcgaattcggcagactgtgccgtcgtactcaccagtccggcagaaagcagcagtgaggataaggcaagttcttgtttcatcgtcagctccttattacataccccgcatttaacaggacgctccatcacggtaaacctgtttgtttattgtgcacaggtaaacgcataagggcgcaaagcaatgtaaaactgactaaaaatcaatctactgttattgacgatacaaaatggcttgtgaataccactggccggttacaaccgtttcatcaaccattaagataacgtaataatcggctttcgcagcgacggctttcgctctgatttcatctattgcatcatccggggagccccgaaccagcgcgcttacggtccccatccgctgtagtccttgcgtttgatcgcgacggatttcctgcgggtgatcggcgacaggcggcgcaggttgcggcgtaccctgcagcacgctacacgcgcttaataacagcgctgctatcaatgaagcaaaccgacgcataactctatctcgtttcctgataatcatagtgtaatgccttattgatttccctttagggggaatgttcccgaagtgttacctgtcacgcgattttcgaatgaaaacgttgcgaaagtgtaacccagttctcaaacattatgaattattgcgctatccataaacttgcgttaagtatttctccgtggcataccggataaaaaggagagaataatgatagcgattgaaacacgacaattagccggaggcgtcgtactacatgccttcccggaagggaaacgcgccgtgccgcttccctgtgtggtgttctatcatggcttcacctcctccagcctggtttatagttattttgccgttgccctggcacaggcaggattccgggtagtcatgccggatgcgccggagcatggcgctcgcttcggcggcgactcacagggacgaatacaccgattctggcagattctgcaccaaaacatgcaggaatttacgacgttacgtgcggcgattcaggcggaaaactggctacttgacgggcggttggcggtgggcggcgcatccatgggcggtatgacggcgctgggcattatgacgcgtcaccgagaggtaaaatgcggggccagtttaatggggtcgggctattttaccgggctcgcccggacgcttttcccgccgttatccccgcagaacccggcacagcaggcggaattcgacaatatcatcgcgccgctacgtgaatgggaagtcacacaccagttagagcgactggccgacaggccgcttctgttgtggcatggtcaggaggatgacgtggtgcctgctatcgaaaccttccggctccagcaggcactcgccgcggcgaagctggataagcatgtgacctgtttatgggccgcaggcgtgcggcatcgcattacgccagaagcgttgtcggcgacggtagcgtttttccgacagcatctttaaacgcggagtatgcttacaccctgggcttcaagctgttgcaaaacctgcggattggcatttttgccggtaatcagcatagcgatctgatcggcgcggctgaacagcatccccgcgcgctcgccaattttactgctatcgaccagcgcgaccagtttcccgacgacgctgagcattttttgttccgccatggcggttagcatatcggtcttgtacaggccatctgcggttaagccctttccgctggtaaacatccagtggccagcatagagactgttttcacttccctgcgggctcagggtaatcgactggcttttattatactgaccacccatgataatcacgctgtcatgctcttgatcgatcagataattcgccagcggcagatagttggtaatgatctgtaccggcttcccgcacatttcacgccccagcaggaaagcggtggagccgcagttaatcactacgctttcacccgggtttaccagctgcgacgccgctttcgcgatgcgtactttttcatcgtggttttgcgcctggtgcagattcatcggcgtccagcggggccgctgttgggtaatggcctctgcgccgttgcgcacttttttaagtttcccgctttcgtcgagcttgttgatgtcgcggcgcgctgtcgccggggagatccccagacgctcaatcacgttttcgacggtaacaaagcccaactgtgccagcatatccagcagtatttgatgtctttgtgcttcagtcatgagctattccgatacaaattgatttgaaaagatgatatttgaaatagcctggaaatactaaagtaaatggaaaaaatgccgggtaatcccggcatgatatcgactcacaggaaggatttgaacggtagatcgggttcaatggtaaagcaatcgtcaaacccacgcggatagtggtattcgaaattgtctttatccagcggccaggtaaacttgccgccaacctgccagataaacggtttaaaaccatacttcaggcgatctttcttcatttcccatagcacgcggatctcttgcggatcggcctggaagttcgaccagatatcgtgatggaacgggatcaccactttggtattcagcgattccgccatgcgtaaaatatccgcgctggtcattttgtccgtaataccgcgcgggttttcaccgtaagaaccgagcgcgacatcaatttgatgttcgttgccgtgtttcgcgtagtagttggaatagtgagaatcgccgctgtgatagagattgccgcccggcgttttaaacagatagttaaccgcgcgtacatccatgccgtccggcagtacgccagcggctttctgatcggcgggcagggtgattaatgcggtgcggtcaaaggcatcaagcgcatgaatttcaatatctttcactttcacgacatcgcccggttttaccacgatgcagcgttctttcggcacgccccagccaacccataaatccacgcaggtctgcgggccgataaacggaacatcatcggcgcaattctgcattacggcagccgcgacattgacgtcaatgtgatcgttatggtcgtgggtcgccaggacggcgtcaatctgacggatagcgaaaggatcgagaacaaacggcgtggtgcgcaggttaggctgtaattttttgacgccagccatacgctgcatctggtggccggttttcatcaacggattaccgtggctctgtttaccggtaccgcaccagaaatcgacgcatacgttagtgccgccttcagattttagccagatcccggtacagcccagccaccacatagcgaacgtacccggcgcgacctgctcttgttcaatctcttcgttcagccagcttccccactccggaaacgtgctcagaatccatgattcacgcgtgatgctttgtactttactcatcgcatttaccttcatgtttgttcaaaatggttcaaaacgtgatttgttttgattaatcctgacactattttctcaagaaggcaatgggctattttttgactttttggaaggagagaacgcagtcaggagaagatttaatcttgtctggcgtcatgtgaatgtttgcatctttatgattttacttattttaatgaaaaaatgagttacctataagtaaaccatgtattaagtgtgctaattatttgcgcgctacgtcacagttaatcaaatttaatcttgttgtgattacttttgaaaattaaagtgaagggactttatcctgagcgcctgtgactcagcaacctcgtctaccggagatcgttatggagatcctctacaacatctttaccattttctttaatcaggtaatgaccaatgccccgctattactgggtattgtgacctgcctgggctatatcctgctgcgcaaaagcgtcagcgtgatcatcaaagggacgatcaaaaccatcattggcttcatgctgctacaggccgggtccggcattctgaccagcacctttaaaccggtggtggcgaaaatgtctgaggtctacggcatcaacggcgcgatttccgatacctatgcttcgatgatggcaacgatcgaacggatgggtgatgcgtatagttgggtaggctacgcggtgttgctcgcgctggcgctgaatatttgttacgtcttgttgcgacgcattaccggtattcgcaccatcatgttgaccgggcacatcatgttccagcaggcggggctgattgcggtctctttctatatcttcggctattccatgtggaccaccattatctgcacggcgatactggtttccctgtactggggtattacctccaacatgatgtacaagccgactcaggaagtgacggacggctgcggtttctccattggtcaccagcagcagtttgcttcctggattgcctataaagtcgcgccgttcctgggcaaaaaagaggaaagcgttgaagacctcaaactgccgggctggctgaacattttccatgacaacatcgtctccacggcgattgtaatgaccatcttctttggtgccattctgctctcttttggtatcgataccgtacaggcgatggcgggtaaaacccactggacaatctatatcctgcaaaccggtttctcctttgcggtggcgatcttcatcatcacccaaggcgtgcgtatgtttgtcgccgagctctctgaggcctttaacggtatctcccagcgtctgattccgggcgcagtactggcgattgactgcgccgctatttatagcttcgcgcctaacgcggtggtctggggctttatgtggggcaccatcggccagctgattgcggttggcatcctggttgcctgcggctcctcgatcctgattattcctggctttatcccgatgttcttctctaacgccactatcggcgtgttcgctaaccacttcggcggctggcgtgcggcgctgaaaatttgtctggtgatggggatgattgaaatctttggttgcgtctgggcggtgaaactcaccggtatgagtgcctggatgggtatggcggactggtcgattctggcaccgccgatgatgcagggcttcttctccctcggtatcgcctttatggccgtcatcattgtaattgcactggcttatatgttcttcgctggccgcgcactgcgcgcagaagaagatgcagaaaaacaactggcagaacagtctgcttaataaggagttttgattatgaccgtacgtattctggctgtgtgtggcaacggacagggcagttccatgatcatgaaaatgaaagtggaccagtttttaacccaatcaaacattgaccacacggtaaacagctgcgcggttggcgagtacaaaagcgagttgagcggcgcggatatcatcatcgcttctacccatattgcaggcgaaatcagcgtgaccggcaacaaatatgtggttggcgtgcgcaacatgctgtcgcctgcggattttggcccgaaactgctggaagtgatcaaagaacatttcccgcaagacgtgaagtaaggatgcaacatgaaattacgtgattcactggcggagaataattctatccgcctgcaggctgaagcgaatacctggcaggaagccgtcaagatcggcgtcgatttactggtggctgcagacgtggtagagccgcgctattaccaggcgattctggatggcgttgagcagtttggcccctattttgtgattgcccccggcctggcgatgccgcatggccgcccggaagaaggggtgaagaaaaccggtttttcgctggtgaccctgaaaaagccgctggagttcaaccacgaagataacgacccggtcgatattctgatcaccatggcggcggttgatgccaacactcaccaggaagtgggcatcatgcagatcgtcaacctgtttgaagacgaagctaattttgaccgtttacgcgcctgccgtaccgcgcaggaagtcctggatctcattgaccgcaccaacgcggcagcttaagaaggaattgaaaatgtcattaccaatgttgcaggtcgcgctggacaaccagactatggatagcgcctatgaaaccactcgcctgattgccgaagaagtcgacattatcgaagtgggcaccattctgtgcgtgggcgaaggcgtgcgtgcggttcgcgacctgaaagcgctttacccgcacaaaatcgtgctggcggacgccaaaattgccgatgccggtaaaatcctctcccgtatgtgtttcgaagccaacgcggactgggtgaccgtgatttgctgtgcggatatcaacaccgcaaaaggcgcgctggatgtggcgaaagagttcaacggcgacgtgcagatcgaactgaccggttactggacctgggaacaggcgcagcagtggcgtgatgcgggtattcagcaagtggtttatcaccgcagccgtgacgcgcaggcggcaggcgtggcgtggggcgaggcggatattaccgcgattaagcggctgtccgatatgggctttaaagtgaccgtgaccggcggactggcgctggaagacctgccgctgttcaaaggcattccgatccatgtctttatcgcggggcgcagcattcgcgatgccgaatcgccggtagaagccgcacggcagttcaaacgctccattgcccaactgtggggctaaggagcggctatgctgtcgaaacaaattccgctcggcatctatgaaaaagcgctccctgccggggagtgctggctggagcgcctgcggctggcgaaaacgctgggttttgacttcgttgaaatgtcggtggacgagaccgacgcccgactggcgcggctcgactggagtcgcgagcagcgcctggcgctggtgagcgcggttgctgaaaccggcgtgcgtgtgccgtccatgtgtctgagcgcgcatcgtcgttttccgctcggtagcgaagatgacgcgatacgggcgcaggggctggagattatgcgtaaagcgattcagtttgcgcaggacgtcgggattcgcgtcattcaactggcggggtacgacgtttactatcagcaggccaacgacgaaacgcgttgccgcttccgcgatgggttaaaagagagcgttgatatggccagccgcgcccaggtgacactggcgatggagatcatggactacccgctgatgaattccatcagtaaagcgctgggctatgctcactacctcaataacccgtggttccagctctatccagatatcggcaatctgtctgcctgggataacgacgtacagatggagctacaggcgggaatcgggcatatcgtcgcggtacacgtcaaagatactaaacccggcgtgttcaaaaatgtgccgtttggcgaaggcgttgtcgatttcgaacgctgcttcgaaacgctcaaacagagtggctattgcgggccctatctgattgagatgtggagcgaaacagcagagaacccggcggcagaggtagcgaaagcgcgtgactgggtgaaagcgcgcatggccagcgccggtctggtggaggcagcctaatgcaaaagctcaagcagcaggtatttgacgctaacatggatttgccccgttatgggctggtgacctttacctggggcaacgtcagcgctatcgatcgcgaacgcgggctggtggtgattaagccaagcggtgtcgcctatgaaaccatgaaggtagatgacatggtggtggtggatatggatggcaaagtggtggagggacgttatcgtccttcttccgataccgctacccatctggcgctgtatcaacgctatccgtcgcttggcggcgtcgttcatacccactccacccacgccacggcatgggcgcaggcggggatggctattccagcgctcggcaccacgcacgcggactatttctttggcgatattccttgtaccagagcgttaagcgaagaagaagtgcagggcgagtacgagctgaacaccggcaaggtgatcatcgaaacgctgggcgaggtggaaccgctgcatacgccaggtattgtcgtgtatcaacacgggccgttcgcctgggggaaagatgcgcacgatgcggtacataacgcggtcgtcatggaggaagtggcgcgaatggcgtggattgcgcgcggtattaacccggcgctgaatcccatcgacgattatctgatgaataaacacttcatgcgtaagcatggcccgaatgcgtattacgggcagaagtgaagtatgagctccggaatgtgaatattatcgggatgtcacaggtctaattccggagccatctttccgcgaaaaaagccccctgctcagggggcaaatcaactatggctttttcgttggttttcctgatgctagcgataaatattcgcgctggcgtgtatattgccgttgctacccggttcccggataagtatgacgtgataatacattgcgtttcgcacgtcggcctcttcattcagcgccagattggcttcactttccgtggcgaagttatggttgatgtagattacgcctaagctgcgcacatcatccatatttctggcctgatgattatttaactcgacggctgccgttgccgttatgccaggcaaaagcgcagccagaaataacattatccgggctcgcatagagtacctcctcagcagcgcggtctggttggcgatatccccctttagtgaatcgcttctggtttaattttaaccataacccgccgcagagatggcgaccttttctgatgctgttgttcaaaaaattatcgcattgtcgctttttacctgattaacaacccattgatgtatgccgccatgtttaagaaatcctgtgtggcaaaaaagtgcgctgaccacagtgtcaatttctctgccgcaacaggccgtttatagtggcatgcgatatgaagttaatatctcagcagcaaaatgtgacgggacaggcgttacgttcggcacgataaataattgtacaatcaccttgagtttgcccgcaggcgccagtattataacgcgtcatttttcagccgacctttaacacgttccttgcctccatgggccgcggctgacccagacaggaggctgaataatccgtaaggagcaattcgatgcgtcattacgaaatcgtttttatggtccatcctgaccagagcgaacaggttccgggtatgatcgagcgttactctgccgccatcactggcgcagaaggcaagatccaccgtctggaagactggggccgccgtcagctggcttacccgatcaacaaactgcacaaagcgcactacgttctgatgaacgttgaagcgccgcaggaagtgatcgatgagctggaaactaccttccgcttcaacgatgccgttatccgcagcatggttatgcgtactaagcacgctgttaccgaagcttctccgatggttaaagcgaaagacgagcgccgtgagcgtcgcgatgatttcgctaacgaaaccgcagatgatgctgaagctggggattctgaagagtaatttctgatgaccaaccgtctggcgttgtccggcaccgtgtgcagggccccccttcgaaaggtcagtccatcaggaattccgcattgccagttcgtgcttgagcatcgttctgtgcaagaggaagccggctttcaccggcaggcgtggtgccaaatgcccgttattgttagcggacacgaaaaccaggccattactcacagtataacggtcggcagccgcataaccgttcaggggtttatttcttgccacaaggcaaagaacggtctgagcaaaatggttctgcatgccgagcagattgaattgatagattctggagactagccatatggcacgttatttccgtcgtcgcaagttctgccgtttcaccgcggaaggcgttcaagagatcgactataaagatatcgctacgctgaaaaactacatcaccgaaagcggtaagattgtcccaagccgtatcaccggtacccgtgcaaaataccagcgtcagctggctcgcgctatcaaacgcgctcgctacctgtctctgctgccgtacactgatcgccatcagtaatcggtcacggtccattaatacgactttgagaggataaggtaatgcaagttattctgcttgataaagtagcaaacctgggtagcctgggtgatcaggttaacgttaaagcgggctatgctcgtaacttcctggtaccaaagggtaaagctgttccggctaccaagaaaaacgttgaatacttcgaagcacgtcgcgctgaactggaagctaaactggctgacgttctggctgctgcaaatgcacgcgcagagaaaatcaacgccctggaaaccgttactatcgcgtctaaagcaggcgacgaaggtaaactgttcggttccatcggtactcgcgacatcgctgacgctgtgactgcggctggcgttgacgtggctaagagcgaagttcgtctgccgaacggcgttctgcgtaccactggcgaacacgaagtgaacttccaggttcacagcgaagtattcgcaaaagttatcatcaacgtggttgctgagtaatcaggcattctcgtttttgctagcaacgaaacgtcggcccagcgccgacgttttgcttttttaaccccatcgcttttcgactggctatctccccctcttttcgcgataatcaaaaataaaacattattttaatttcttggtgaaagaatggatacccaacgccaggcctccccgtttgcccgcaaaaacgtcgtttatgtgtgtgccgcattttgttgcttgctatggggcagcgcttatccagccatcaaaagcggttatgacctctttcagatagccaccgatgatatcccttctaaaattgtttttgctggttatcgttttttgtttgcgggtgggttgctactactgttcgcgctgcttcagcgtaaaccgattggtcggtttcgtccgcgccagtttgctcagttgacgttactggggctgactcagacgtcgctgcaatatctctttttctatatcggccttgcgttcacctccggcgtgaaaggctcaatcatgaacgcgacaggcacattcttcagcgtattgctggcgcactttatttatcagaacgaccgattgagctacaacaaaacgctcggctgtattctgggctttgcgggcgtcatggtggtgaacgtcagcaacggcctggatttcagctttaatctgccgggagaaggctccgtggtgctggcggcgtttattctttctgcggccacgttgtatggcaaacgtctctcgcagacggtcgatccgatggtcatgactggctatcaattggggattggcggtctggtactggtcattggcggttacgtttttggcggtacgctgacgatacatggcttctcgtcggtggcgattttagtctacctgacgctgctctcgtcggtcgcttttgcgctatggagcattttactcaaatataatcgcgtggggatgattgcgccgtttaactttctgatcccggtttctggcgcggctctttcggctatttttctcggcgagaatatattggagtggaaatacatgattgcgctggtgctggtgtgttcggggatttggtgggtgaataaggtgaagcggtaatgcttcacctgaacgaatagggtatagacggggtaaggcgcagccggcgttactgtgcgcgaataaaactgccgtcaggctgacgcgtaaacagcacctgttgaccgttatcgccatctatcgttaaacctgtcaccaccccgctggcattctggcgaattttaatcatttgaccatttttgagattactcagcggcttgccagcgccttctacctgcgccattgcataaacgtctgtcgggggcagcccgtggtcacggaacagttgcgccagagttttaccagactctacccggtacgagcgccactgttgaccgatgccgctatcctgctggaaaggctgcgtctgcggctggttttgttcttccggctggccttcctggataggttccggcgcaacgggcgccacctgatccggatcgttttgcggcgcgaccagctgcgcctgaagctgggcctccgtcggcggctgtgattgcgattgcagatccaattgcgcttcccgcgtgacgacaggtgagtcgctggtctcgctggcgggcagcaggaaaccgatcaccagcacgatagcggcaatgataatgccacgacgatgcataggcggcagcggttccatgatgcgaaaattatccggcgcgtgccagattttcgccagggttggttttaattcaaagcgcccgggcatggtttacctcctgctccgcatctcgttccttaatcatagagtatagatggctaacgctatgatactggtagtgctatccgctttcgtgacatcaatacggataatctattgtttctttttccctgcgatttgtcatcctccctgagacaaagttttaccagaagaagcgtggctgttatgctgcccgctacttttttgatatccgatgaaggaaaaataatggccaccccgacttttgacactattgaagcgcaagcgagctacggcattggtttgcaggtagggcagcagctcagcgaatccggtcttgaagggctgttgcctgaagcgctggttgcaggcattgctgatgcgctggaaggtaaacacccggcggttcctgttgatgtggtgcatcgtgcgctgcgtgaaattcatgagcgtgcggacgcggtgcgtcgtgagcgtttcaaagcgatggcggccgaaggcgtgaaatacctggaagaaaaccgcgaaaaagacggtgtgaacagtactgagtctggtttacagttccgcgttctgacgcagggcgaaggcgcgattccggcgcgtaccgaccgcgtacgcgtgcattacaccggtaagcttattgatggcaccgtatttgacagctccgtcgcgcgcggcgaaccggctgaattcccggtaaatggcgtgatcgccggctggattgaagcgctgactctgatgccggtaggttccaaatgggaactgactatcccacaggagctggcctatggcgagcgtggggccggggcatctattccgccattcagcaccctggtgtttgaagtggaactgctggaaattctgtaagcgccccgggtttgccggatgatggcgtaaacgccttatccggcaaccctggcttcagcagatgccaatattttattttgcaaatggcgtcgttacgtgtatttttgtgagctaattcgcattatcaaagtgatataacactcattttaaacataaaattaacattgtatttgaatcttagtattcatcccgccgattcttacctaatatcgatgagtcctgataacaggatcgtcgtatcatagaccaaaggccgtagagcccgcacaacacagacaggtacaggaagaaaaacatggtagatcaggtaaaagtcgcagccgacgaacaggctccggctgaacagtcgctacggcgcaatcttacaaaccgtcatatacagcttatcgctattggcggcgctattggtaccggtctgtttatgggatcgggtaaaacgatcagtctcgccggaccgtcgatcatttttgtgtatatgatcatcggttttatgctttttttcgtgatgcgcgccatgggggaattgctgctctcgaatctggaatataaatcgtttagcgattttgcttccgacctgcttggcccctgggcgggatatttcaccggctggacgtactggttttgctgggtagtgaccggtatggctgacgtggtggcgattaccgcctacgcgcagttctggtttcccggcctttccgattgggtcgcctcgctggcggtagtgatcctgctgctaagcctcaacctcgccaccgttaaaatgtttggtgaaatggaattttggtttgctatggtcaaaatcgtcgccattgtggcgttgattgtggtcgggctggtgatgattgcgatgcactttaaatcgccgacaggcgttgaagcgtctttcgcgcatctgtggaatgacggcggctggttcccgaaaggtattagcgggttctttgccggtttccagattgcagtgttcgctttcgtgggcattgagctggttggtactaccgccgcagaaactaaagatccggaaaaatcgctgccgcgcgcgattaactcaataccgatccgtatcatcatgttctacgtctttgcgctgattgtcattatgtcggtgacgccgtggagttccgtggtgccggataagagcccgtttgttgagctgtttgtactggtgggtctgcctgccgctgcgagcgtgatcaactttgtcgtgctgacctcggcggcgtcttccgccaacagcggcgtcttctcgaccagccgtatgctgtttggcctggcgcaagaaggcgtggcgccaaaagcgttcgctaagctatcgaaacgcgcggtaccggcgaaaggcctgaccttctcctgtatctgcctgctgggcggcgtggttatgctgatggtcaacccgagcgtgattggcgcattcaccatgatcactacggtttcggccatcctgtttatgtttgtctggaccatcattctgtgttcatacctggtgtaccgcaaaaagcgtccccacctgcatgaaaaatccatctataagatgccgctcggtaagctgatgtgctgggtctgcatggcgttctttgcattcgtgctggtattactgacgctggaagacgatacgcgccaggcgctaatcgtgacgccgctgtggtttatcgcgttgggtctgggctggctgttgataggtaagaaacggatggcgggaatgcgttaattgttttgcccggtggcgctggcgcttaccgggcttacagcgtaacgttgatttggaggccggataaggcgccgtttacagccgccatccggcaaaatgcccggctggcgattattccccggccagcgcgcgtgggaacagcacgttattctccaggctgatgtgctccatcagatcatcaatcatctcattaatgccgttatacatcgctttccaggtggtgcaggcttctggcggcggcgttacatttttggtgacgtgtttgatgacgtctaccagctctcccgcctcgtcatgctcgctttccattacgcttatcgggcccgttgcctggcgacccataccctgtttgatcatggggaacaggatctgttcttctttcatcatatggctggaaagctcttcatgcagcgcggtgagatattttgtcaggccgcgtgggacgtttggcttatccgcgtggacgcgttccactttggttgcctgcagaataagctccggcagttgttcgcgatgtcggtcatgatagcgaacaacgatatggtcaataatgtccgccagcggaacggcgcgccagtctttttcgatgggctgttcagccaactgcgccagttgcgcttctatgatgtcaatatcgacgtcgtgacgcgcggcggcgcgcgccagcgtctgttttccgccgcagcagtaatccatatcgtactggcgaaacagcgccgatgcgcggggaatagagagcgccagttcgcctaaaggttgatcgcgataagccatagccgttacctcatttgcaataatataagttgtattttaaatgcatctttaaggcgaagctataactctttcggggtgcgtataatttaagcgagtatgaaattagcgttccgtgaccggaacgacggtcgctttttccggtttcgctctcacggcaatgaccacgcccgccaccaggagcgcaatgccgcttaacgtcaggaatggcgggatttcctggcgcagaatgaaggtatagagcagtcccgccaacgtctcaaaaacaatcagcggccctaaaataacggttggcaatttttggctggcgatattccagcacagcgcgcccacccaggaacacagcaccgcgatggcgatcatcagaccgataaacagcgcgggatgcgggccaaagggcagggtaaacagcggtttctggatactcagccacagacagaccgccgcatagccgattaacgagaccggcagcgtaaccagcgcctgcgccgttgcccacatcatgggatgtttgtcgggattttcccgcagccagcgggcgttgcgcagcgcataccatgcccagcacgctacggaaatcagcgccagcacaatgcctgaaccatagcgccagccgctaacatcggacaatccctggctaagttcagcaatattgacgcacagcaggccaaaaccgataagcgccagcgcgggcgctaaacgccgccaggataatctgccgtctcgttggctatagagaacgttagcgaaaagcggaatgacgaccggcaatgtcccgatgatcatcgtcgacaccggcgcgccggttcgctgaatggcgctggcgaggcaggcgtaatagattacattgcccatcagggtcagcgacagggcggtggaccagtctttgcgcgttaactggcgtaaccgcgtgcggcctaaccaggcaatcggcagggcaatcagccccagcgccagatagcgtcccattgactgtaagagggccgggtaatccggcacgattaacgggccgacgaaaatcaatccccacattagccctgccagcagggcgtatagcacgccgctaatcatcagattctcctcataaaccgttccgtcattatcagagaaggtctatgaggatgccacataaattaactaaattttaacatttacagtacggagcgaaggctttctgtgagcgtcgtcgtcgggcgaccgatgagtttacgcagcgtatggctgtcatcaaacaggccgcctttcgccgcgccagcgtcagaattggccaacatatccgccagtccgtcaggcaggcctgcgcctttcagcgcggcggcaaaatcgacttcgctcaggttctggtagacgattttttttccgctttgatgagtaagttcatccgccaactggcttaatgtccaggcgtcatcacccgccagttcgtagacattcccggcgtgaccctcttcacggatgacgcgcgcggcggcggcggcatagtcagcgcgcattgcggaggcgattttcccttctcccgccgcgccaataaagacgccatgcttcagcgcggcagggacgctcgccaggtagttttccgtataccagccgttacgtaatagcgtgtgaggaatacctgactcagccagcatcttttccgtttcaatatgttcatcggcgagcgccagcggcgatttatccgcatgtagcaggctggtataggcgatgaatttcaccttcgcggcaatggcggcctgaataacgttgcggtgctgcgcggtgcgttgtcccacttcgctggatgatataagcagcagtttatcaacgccctgtaaggcggtggtcagcgcggcttcgttagcgtaatccgcctggcgaacggcaatcccgcgctgactgagcggggcggcttttttcgggttacggacgatcgcgacgaggtggctggcgggcgtcgtttttagcaggttttcaataacgtgttggcccagttggcccgttgcgccagtgatagcaatcatggtgaactcctcagtgttggtcttgtgttttattacgctaccacctaaacttacttttagtaagtacgtacaaaaaggtaagtatcaatgcgcgctcatactctttcccggcagttgcgtgaaggcaatctctttgctgaacagtgcccgtcccgtgaggtgttaaaacatgtcaccagtcgctggggcgtactgattctggtggcgttacgcgacggtacacaccgttttagcgacctgcgccgcaagatgggaggcgtgagtgaaaagatgctggcgcagtcgttacaggcgcttgaacaggacggatttcttaaccgggtgtcatatccagttgttccgccgcatgtggagtacagcctgacgccgcttggcgagcaggtgagtgataaagtcgccgcgctggcggactggatagaactgaatttgccgcaggtattggcgcagcgggaacgtttatcagatggcggctagcgctttattcggcctgccagtcaggccgaataaacgcagcgccatacgggacacacgttacttgcttaaatccacctgataaatggcaaaaccgatatcatcgacggcaaccttcttcatcggatactgccctttcgctttaatgaaggcagcggctttatcgcctggcgatgtttcaaagcggatatccagcgccgtatcgctgtggattggcgccagacgccagttattatccgccgccggatggatttcgcccgcgcgttttgactctgcgccaatccatgccgccagcacggcgcgattttcatccggagacgcaaaggcgatatggctgtcgcccgtgccggcaaacttgccgccgtaagcgcgatagttattcgtggcgaccaggaacgtagcgttcgggtcgacaggcttaccgttaaaggtcaggtttttaatacgttccgcctgcggattcaccatctggcattcgccatcatagcgggcgggctgtgacacatcgatttgataattcacgccgtcaatgacatcgaaattataggtgcgaaagccatcccaattgatcaacgattgcggtttgttgctgtgaatatcaatctgattaaattgtccggcagaacattccagccactcttttacctccttgccgctggctttcaccaccaccagcgtattcggatagagataaagatcggcggcgttacggaaggtcaactggcctttttccacctcgacaaagctggcaggatcgttcttacgcccgccaactttaaacggcgcggcggcggacagcaccggcagtttcgccagatccggatcgccctgaataaagtgttccacatacgctttttgcgcgttattcaccacctgtacggtaggatcgtcctgcaccagagcaagataactgtacatattatcggcggatttaccgatgggcttgctgacaaactcgcgggtggcatcgtgatcggctttcagaataccgaccagcttactgtcttccgccgccagcgactttttagcggcggcgtcatagataggccgcgcttccgctttcgcctgcgtaacctgccatttgccgctgtcgttattgagcaccagatcgaccactcccagatggtcgccccacatgccaggcattaccgcaggaatgccgttaagcgtacctttggcgatatccgcgcctttgatgtcggcaaaatctttaccggggaagacggcgtgagcgtggccaaacataatcgcgtcgacgccaggaacttcgctgaggtaataaaccgagttttccgccatgctgtggtacggatcggcagaaagacctgaatgagcaatgactaccacgatatcagcgcctttctcgcgcatttcgggcacatatttccgggcggtttccgtaatgtcattgacggtaactttgccgctcaggttcgctttatcccaaatcatgatttgcggcggaacaaagccgatatagccgattttcagagtttgcgggttgccgtctttatcaataacgctcgtctctttaatcagataaggcgtaaagagcggcttttgggttttaacgtcgataatattggcgttaacataagggaatttcgcgccagccagcgcgttatgcagatagtccagaccataattaaactcatggttgccgaggtttccaaccgcgtaatccagagtgttgagcgctttatagaccgggtgaacgtcaccgtctttgagcccttttgccgccatataatcgcccagagggctcccctgaatcaggtcgccgttatccaccagcacgctgtttttgacttcatttcgggcggcatgaatcaaacttgcggtacgtaccaatccgaatttttcggttgcggtatccttgtaataatcgaaatccatcatgttgctatgtaaatcagtagtttccatgatacggagatcgacggtggccgcattcacgctggcggcgatcagcgtagccagaagcgttgcactaaacttaatcatcagaggcaccttttaagaacgcaatagaaaagccggatagtgaaaaatagcgatgacaaacagtgaaacccgatatcgttccaaccgtcgccagaagaaggcgaaaccgccccatccggccgattttttgcgagtgttcacagaaaggtgaatcatgccatgaaagctattatcaaaaccgctgacggtatcacagttggcggaacccttaacgatcgggtataagtaaaacaacgagttaacgcccccgtcataaagaggtggagaatgttagaacaagtatgccagcttgcacggaacgcgggcgatgccattatgcaggtttatgatggagccaaaccgatggagtacgcccgcaagcaggacgattctccagtcactgcggcggatatcgccgcacataccgtgattctcgaagggttacgcacgctcacgccggatattccggtgctttcagaagaggatccgcccgcctgggaagtgcgccagcactggcagcgttactggctggtcgatccgctcgacggcaccaaggagttcatcaagcgcaatggcgaattcacggtcaatatcgcgctgattgagcagggcaagccggtgttgggcgtggtctatgcgccggtgctgaaagtgatgtactacgcggcggaaggtaaggcctggaaagaggagtgcggggtgcgtaagcagattcaggtccgggatgcccgcccgccgctggtggtgattagccgttcgcatacggatgatgaactcaccgaatatctccaacagcttggcgaacatcagacaacctctattggttcctcgctgaaattctgccttgtggcggaaggccaggcgcagctttaccccagatttgggccgaccagcgtctgggacactgccgcaggtcatgccattgccgttgcagccggggcgcacgttcacgactggcagggaaaaacgctggactatacccctcgtgaatcgttccttaaccccggcttccgggtgactatttactgaggagcttatgcagcaggtcgaccacctgctgtacctcttgctgggttaacgcgccatctttcacccattgaacccgaccgtctttgtcaagcacgatgacggcggacccctcttcttttaattgccaggcgttacgcgccacgccattgctgtcgacaataaattgcgaccacgggtagagctttttattactttctatactgctacgcacgaacataccggagcctgggatcgcatcatcggtgttcacaattgtggtcgtctggtatctgtcatgcgggagcttggctgatttaatcgcttcaatcagcgtggcgtttttttccttcgctgacgttcgacccgcaatgtgcagcaggacgcgcacttttcccgccagctgcgcgctattccagtttttataactaaactcatctttattcaacgtcagttcgccacggtcggcaatgcctaccggcggcacccgttggttaacttcaaggttatgcgcacaagccattatggggagtagcagacacgacatcgccagaattttacgtaaggtcatggtcattccttctttatttttttgcaggtgatccgaccactttgggccgatagttaatcatatgtgcgattgatgctttttcccgcaaaggggatgccagtttgcgggcgggcgcacacttcctgtgaaaaatgaaggcatatactgagaaaaatgagctgatgtttagataattctgaataactgtaatcaaaaggtaaatatacttatgcacactggaaacgacgtagatatggtctatagtcatatggcattaaaatttgcgccttaaaactgttgggccgattgtggcatcgcaagggcgtaatactctgcaggagacaacaatgaaaattttccaacgctacaacccgctacaggtggcgaagtacgtgaagatcctgttccgtggacggttatatatcaaggatgttggcgcttttgagttcgataagggtaagattcttatcccaaaagtgagagacaagcagcacttgtctgtgatgtctgaagttaaccgtcaggttatgcgtctgcaaactgagatggcgtaaccaaaagtgctatgcagtaggttaaaaaagtaaaaaaaaacggctcctgaatcaggagccgttgatgtttctggcaaacggatttcaggccgcgctgtcttctttaccttgcgcatcgggcagtttcggcgccggtacgttgcttttattgtcgagacgcgtcaccagcaactgatcgatacggtagttgtcgatatccaccacttcaaatttgtagccggaaaacttcaccgaatcagtacgttttgggatcttgcgcagcataaacatcataaagccgccaatggtttcatagttgccggattgcggaaactcatcgatatccagcacgcgcatgacgtcgtcaatcggcgtgccgccgtcaaccagccaggaattttcatcgcgcgccacaatttgctcttccagtccctggccgaccaggtcacccattagcgtggtcatcacatcgttcagcgtaatgataccgacgaccagagcgtattcattcataatgaccgcgaaatcttcgcccgccgttttgaaactttccagcgcctcagaaagggtcagcgtatccggcacaatcaaggtattgcgaatttgcacgccgctattcagcgccatactttggttagccagcacgcgattcagcagatctttggagtctacatagccgatgatgtggtcgatatcttcattacacaccaaaaattttgagtgcggatgttcggcgacctttttcttcaggctttgttcgtcttcgtgcagatcaaaccagatgatactttcgcgcgacgtcatagaagacggtacggtgcgagattcaagttcaaacacattttcaattagttcgtgctcttgcttgcgcaagacgcccgccagcgcgccggcttccaccactgcgtaaatatcatcagaagtaatgtcgtctttccgcaccattggaattttgaacaggcggaagatgttgtttgccatgccgttaaacagccacaccagcgggcgaaaaacgaacaggcagaagcgcatcgggttgatgatacgcaaagccacagcttctggcgcaatcataccgatgcgtttcggggttaaatccgcgaacaggataaacagccccgtcaccagcgagaaagagagaataaagctcagctgctcggagagttctggcgacatatagtgcgagaagagggcggaaaaggcgggcgaaaatgccgcatcgccgacgataccgccaagaatagcgacggcgttcaggccaatttgcacaacggtgaaaaacatgccgggattttcctgcattttcaatacgcgttgtgcgttgatactgccttcatcagctaataacttaagtttaatcttacgtgatgcggcaagcgagatctcggagatggagaagaacgcacttacagcgatcaggcagaatataatgaatatactgtttaacatatcttatccggcgaaacgccagatcctcggaagggaagtttataaatccgtgtggtaacgtttaatgaaaaccggctcgtagcagtgagccgataagttcagggctagtatagcgtaagctactgtaaagtcgccagagggttcattttcaactccgacaagttccccctacgccagcgtcgtcacgcgtcaggcggcaggcaaacgccgatcccgccaatcccgcagtaaccatatggatttttgtgcagatactgttggtgttcatcttcggcgtagtaaaacggcgtcgcatgggcgatttccgtggtaatagggcgatggtctccggcggcggtcattgccgactgaaagcgctcgcgactggcgtgagcggcggcattctgttccggcgttaagggataaatcgcagaacggtattgcgtaccgtgatcgttaccttgttgcatcccctgcgtcggatcgtgattttcccagaaggtctgtaaaagctgctcataactgataacggcaggatcgtacactatccgtaccgcttcggcatgaccggtctgcccggagcagacttcccggtaggttggattaggcgtgtaaccgcctgcataccctgccgcggtgctatatacgccgggcaattgccagaataaacgttctacgccccagaaacagcccatagcgaagtaggcgatctccatcccggcagggacattggtcatagagtgttcatttaccgcatgcagagtggcgatcggcatcggggtgttgcgtcctggtaacgcatctgcttgagtaaccagatgttttttatcaaataaactcatgagctattctcccgaaagcgttaattggcgttaaggttgtaacgagacgcatctttgcacacaataacaacattaatgtatctggatttaaccataagaaatatttgggcagtcgtctgcttttcaatcgaaattgttgattttatgttaagccgcggagcggtagtgtgattttttccaggggtgggaataggggatattcaggagaaaatgtgccacatatccgtcagttatgttgggttagcttactgtgcctgagcagttctgcggtagccgcaaatgttcgtctgaaagtcgaagggctatccggagagctggaaaaaaacgttcgcgcacagctctctacgattcagagcgatgaggtgacgccggatcggcgctttcgcgcccgagttgatgatgcgattcgcgaagggcttaaagcgttaggctattacgaacccactatcaaattcgacttgcttccaccgcctgcgaaaggacggcaggtattaatcgccagggttacgcccggccagccggtgttgattggcggtacagaagtcattttacgcggcggcgcgcgcacggacaaagattatctggccttactgaaaacgcgtccggcaatcggcacggtgctgaaccagggagactatgacaattttaaaaagtcgttaaccagcgtgtcgctacgtaaaggctatttcgacagcgaattcattaaaagtcagttgggaattgctctgggccgccatcaggcgttttgggatattgattatgatagcggtgagcgctatcgcttcggacctgtcaccttcgaaggttcgcagattcgtgatgaatatttacaaaatctgttgccgtttaaagagggtgatgagtacgaatcgaaagatttggcggaactaaaccgccgactttccgctaccggatggtttaattctgtcgtggtggcgccggaatttgagaaatcgcgtaaaacaaaaattctgccgttaaaaggcgtggtatcgccgcgaaccgaaaacacgattgaaaccggggtggggtactccaccgacgtcgggccgcgcgtgaaagcgtcgtggaaaaaaccgtggatgaactcttacggtcatagcctgaccaccagcaccagtatttctgcgccggaacaggtgctggattttagttataaaatgccgctgctgaaaaacccgctggagcaatactatctggtacagggcggttttaaacgtaccgatttgaatgatacggagcaggactcgaccacgcttgccgtgtcgcgttactgggacctttccagtggttggcagcgggcgattaatctgcgctggagtttcgaccactttacccaggggaacgtcaccaataccaccatgctgttctacccgggcgtgatgatcagccgaacccgctcgcgagggggactgatgccaacctggggcgattcgcagcgctattcagtagactattcgaatacggcctggggctccgacgtggatttctccgtgctgcaggcgcaaaacgtctggattcggactttgtacgatcgccaccgttttgtgatgcgcgccaatttgggctggatagaaaccggtgatttcgacaaagttccgccggatttacgtttcttcgccgggggcgaccgcagtattcgcggctataaatacaaatctatttcgcctaaagatagcgacggcaatcttaaaggcgcctcaaaactggcaaccggatcgctggagtaccagtataacgtcaccggtaaatggtggggggcagtgtttgtcgatagcggcgaggcggtgagtgatattcgccgtagcgatttcaaaaccgggaccggggtcggcgtgcgctgggcgtcgccggttgggcctgtcaaactcgattttgccgtaccggtcggcgacaaagacgaacacggtttacagttttatatcggtctggggcctgaattatgagtttatggaagaaaataagcctcggcgtgttgattttcattgtggtgttactggcgagcgttgcgtttctggtcgggacgacgacggggctgcatctggtattcagtgcggcgaaccgctgggtgccggggctggagattgggcaggtcaccggcggctggcgggacttatcgttaaaaaatatccgctatgagcagccgggcgttgcggtgaatgcgggcgaaattcatctggccatcgggcttgattgcctgtggcgcagtagcctgtgcgtcaatgatctggcgctaaaagatattaatgtcgctatcgacagcaaaaaaatgccgccctccgaaccggcgcaagaagaggaagaaagcgggccgctgaacctctccacgccctggcccatcacgctgtcgcgcgtggcgttgaataacatcaatatcaagattgatgacactaccgtttcggtgttggattttacctccgggctggcatggcaggagaaaaacctgaccctgaaaccgacgcggcttcagggactgctgatcgcgctgccgaaggtcgctgacgtggcgcaggaagaggtggttgaacccaaaatcgagaaacctcaaccggatgaaaagccgcttggcgaaacgctaaaagatctgtttgcaaaaccggtaatgccggagatgaccgatgttcacctgccgctcaatctgaatatcgagtcatttcgcggcgagcagctacgcatcaccggcgataccgatctgacggtgcgcacgatgctgcttaaagtcagcagtatcgacggtaatatgaagctggatactctggatatcgacgccaaccagggcacggtgaaagcctccggtacggcgcagctcgccaataactggccggttgatattacgctcaacagtacgctgaatatcgatccgctaaagggtgaaaagataaaactcaaggtcggcggcgcgttacgcgaacaactggaggtcggggtgaacctttccgggccgatggatgtcgcgcttcgcgcccagacgcggctggcggaggccggtttaccgctcaatcttgaagtcgtcagccaacgcattgcctggccattgacgggtgatacccagtttcaggctgacgatctgaagctcaaactgagcggtaagatgaccgactatacgttgtcgatgcgaaccgccgtgaaaggacaagatattccgccggcgaccatcacgctggatgccaaagggaatgagcggcagattaatctcgataaactcaccgtcgccgctctggagggaaaaaccgaactgaaagcgctggtggactggcagcaggcgattagctggcgtggcgaactgacgctgaatggcatcaataccgctaaagagattccggactggcccgcgaagcttaacggcgtcatgaaaaccaaaggcagcctctacggcggcacctggcagatggatgtcccggagctcaagctgaccggcaatgtgaagcagaacagcgttaacgttaacgggacgctaaagggcaacagctacatgcagtggacgatcccggggctgcactttgcgctgggcccaaacagcgccgatataaaaggcgagcttggcgttaaggagctgaatcttgacgccgccatcgatgcgccagggctggataatgcgctgccaggactgggcggcatggcaaaaggaatcgttaaagtccgcggtacggtagaagcgccgcagctgttggcggatatcaccgcccgcggcttgcgctggcaggagctgtctgtcgcccaggcgcgcattgagggcgatattaaatccaccgatcagatagcgggccatctcaacgttcgcgtagagcggatttcgcagcccgacgttaatatcaatctggtgacgcttgacgccaaaggcagcgagaagcagcatcagctacagctccgtgttcagggagaaccggtatccggtcaactctccctgacaggcagcttcgatcgcgaggcggcgcgctggaaagggacgttaagcgacacccgtttccagacgccagtggggccatggtcgttgacccgcgcgattgcgctggactaccgtaataaagaacagaaaatcagtatcgggccgcattgttggctgaacccgaacgccgagctgtgcatcccgcaaaccattgatgcgggcgccgcaggacgggcggtggtcaatctcaaccgctttgatctggcgatgctgaagccatttatgcctgataccactcaggccagtgggatctttagcgggaaagcggatgtgtcgtgggacaccacccaggagggattgccgcaggggaaggtcacgctttccggtcgtaatgtgaaggtcacgcagaccgtcaatgacgcgccgttaccggtcgcgtttgagacgctgaacctcagcgccgatctgcacaataatcgcgccgagctgggatggctgattcgcctgacgaacaatggtcaattcgatggccaggtgcaggtaaccgatcctcaggggcggcgcaatctcggcggtaacgtcaacatgcgcaatctcaatctggcgatggtcaaccctgtcttttcgcgcggcgaaaaagcggcgggaatgttaaacgccaggctacgtctgggcggcgatgtgcaaagcccgcagttgtttggtcagttgcagcttagcgcgctggatattgacggtaactttatgccgtttgagatgcagccgagccagctcaccatgaactttagcggtacgcgttcgacgctcgccggtatcgtgcgaacacaacaagggcaaattaacctgaacggcaacgccgactggagtcagattgacaactggcgcgcgcgggtgacggcgaaaggcagccgggtgcggattaccgttccgccgatggtgcgcctggatgtctcgccggatgtggtctttgacgcgacgccttcgctgttcacgttggatgggcgtgtggacgttccgtgggcgcgaattgtggtgcacgacctgccggagagcgcggtcggcgtctccagcgatgtggttatgctcaacaatgacctgcaaccagaaacgccgcagacagcgtctattcccatcaacagtaatctgacggtccacgtcggcaacaacgtgcgcatcgacgccttcgggcttaaagcgcgtttgaccggcgatttgaaagtcgcgcaggataagcaggggctggggctaaatggtcaaatcaatattcctgacggccgattccgcgcctacggccaggacctgcttgtccgtaaaggcgagctgctgttctccggcccgccggatcagccgctgctcaatatcgaagcgatccgtaaccctgacgccaccgaagacgatgttattgcgggcgtgcgcgtcacaggcacagctgatgaacccaaagcggaaatcttctccgatccggcgatgccgcaggctgaagcgctttcttatctgctgcgtgggcaggggttggacagcaatcagagtgatagcgcagcgatgacctccatgcttattggcctgggggttgcgcaaagtggtcaggttgtgggtaaaatcggagagacattcggtgtaagtaatctggcgctggacacgcaaggggtgggcgattcgtcccaggttgtggtcagcggctatgtactgccgggtctacaggtgaagtatggtgtagggatatttgactctctggcgacgctcacgttacgttatcgcctgatgcctaagctatatctggaagcagtgtctggcgtagatcaggcacttgatttgctctatcagtttgagttttagcaatgcgaatatttgtctatggcagtttacgacagaaacaaggcaacagtcactggatgaccaatgcccaattgcttggcgattaccgtatcgataactaccagttgtatagtctgggccactatccaggcgcagttccgggaaacggagcggtatacggtgaagtttatcgaattgataacgccacgctggccgaacttgatgctttgcgcaccaggggcggtgaatacgcacgccagttaatccagacgccttacggcagcgcatggatgtatgtatatcaacgtcctgttgatgggttaactctgattgaaagcggtgactggttagacagaaaccagccctgaactgaacacgccaccctcgggtggcgttgttttttacattctggctgatggcgctagcgccgggcatggtgagctcttattctgccgtagatcaataatgacgcgccgcccaggataacaatgcatccgagaaccataaatccctgcatgtagctgccggttgtccggtaaaaatagccgaccataaggcctgccaacgtaccgccgccgccggcgccgatgccattaataataccggaggctgggccaatcgcatggggtttaacgttcgactggataatcgaccagatattgggggtaaagctggcggcataataacccatcgccagggtaatgagcgtgattttaaagcccggcgcatcgacaaatggcaggagaaataacatcacgccggggattagtaggcccagtgaagcaataagtacacgtttttgtgtcttatcactgatccatgagatagggattgccagtataaccgcagtcagataaggcagagaactgaccaatgctttactgaatccggtatagccgagagaattgacaaccatgggtatccataacgtaattccccagaacaacatcccttgagtgatgtaggtaaaaataaggagtaggaagggggttccgcccagcgattccagggtaagtttagttttctctgttggcgccggcgcacgataataaggcgcttcttcctgttttttcagcattgttatataaagtggaaccacaacaacaatgccgatcacaccagtgataataaaaacatttcgccaaccgaaggcagcatccagcggggacaaaatcataaatcccaggcctaatgccaggaactgtccataatactggataatgctgttcgcctgcgtccgttctttgtctgaaaaccagtcgctggcgaagcgggactgctgcggccaataaatgccttcggtaatgccaagcaccagccgacaaatcaaaataacgtacactgacgaggtaaatccgacaaaaacggtcgcaatcgaccagattagcaccatcagaatgactatttttttcggatcgtatcgctgggtaaatacgccgccaaaaatatttgaaaaggcatagccaataagaaatatggttaatacaatgctggccgttgcgccatcaatattcaggtcgtgtgtaatcgtaggtaacgtaacggaaagattagaacggtcaagataagcaacaaaaaggccgaacattaatgtcgcgccgatccgtagccatttttgcattgaggtcatttttcaactccgtttggccgcgcgccaaaatcaatttgacgaaataatatctcaccggattttatggtcatttgtggtaccagcacatgcgtccccgtgagcgtttcaccatgaatatcggcaaattcaacatgcctgttttttaatttaaagatggcgatatcggcaaatgccccaggggccagcgtaccaatttctgctgccatacccattaaaactgctggggtatgggtacaggcgttaatgacatcggtaagcgcgacgccgagtgctaaatatttcgataaaatccatggtaaggcgtaaacaggccaggcgagtttagtgatggttgagagatcgctactgatgatatccggaagaaagccattggcgatggcccggcgtgccgtgttcattgaaaaatggctgcgaccattggcggcatcaaatataacgcctctttcccttgcctgacggacttcggctaagaccacgccttcatcagtaagaatggtgctacctttgccgtgaaacgcatgagcgataatatcgcctcggcgtagcaaggagacaagttctttcatgggaacgacgggatgagtcgagtgtattgccacgggacactttaaatcgttggcaatacgaagggattcagtcagcggttttaagccatattcagcaatgtcctcagtctgaaccttgagttttaatccctgaagaacgttgcgatactgacgaaacagcgcgtggatcttattttcatcaatattgtcaggatcataattttcttgtgaccaggtttggcccggcggcgacacggtcaaaaacgctttgattcgaactttgctggcgcaaatcaccgttcggtagaaggcatcaaagtttgccgtaccggcagaacctgcatccacgacggtggtgacgccattcggcggcatgtacatatcaggcctgacgccgccttccgtcgcgtcataaaaaacatgcgcgtgataatcgataagaccgggagtaacgatcatgccgtcggcatggataatccgggtctccgaagttacaggatatttatcggcatcaacgataatatcgttaatgatgcgtaaattgttaatctcattaatattacgagcgggatcgatgatatgtccaccggtaattaatatatcatttttcatcataatctcttaaaatagtaaataattatggcagcccttaaaaatatattaaaaagtgtgttttgagcggatgttatgttggattaaaaatacggttattggtagggagagcttaggataccttattaaaaaggtaatcgggcttatgcactaaataagactttagcgcttgctaatatttagggcgtaagtccatgggagtctgggagcattcacaaaacaattattatcttaagctttttagagaaaccgtgagcgtattcaaccctttttaataaaaaatcaggtaaagtattattcattccgtgaatgttaaattaataatgataaaaactgtgttctattcattagccaataaaaaggccctcattactatgagagcctttatcttgacgcttatgtaaaagcgaacttatttcttcgctgcgcgctcgaaggaggcaacgatttccgctttagccgcttcggcgttgtcccaaccgtcaactttcacccatttgcctttttcgagatctttataatgctcgaagaaatgagtgatctgcgctttcagcagttccggcagatcgttcacatctttaatgtgatcgtactctttgctcagtttggtgtgcggtacggcaaccagtttcgcatcttcaccggattcgtcggtcattttcagtacgccaaccggacggcaacggatgacggcgcctggctgcagcgggtacggcgtcgggaccagaacgtctaccgggtcgccgtccagagacagggtatggttgatgtaaccgtagttgcacggatagaacatcgctgtggacatgaagcggtcaacgaacagcgcgccgctctctttgtcaacttcgtatttgatcggatctgcgttagccgggatctcgataacgacgtagatatcttccggcagttctttacccgccgggacgttgagtaagctcatgtctgtttcctttgaatttatgacaaacaagtggcgagtattatagccaactcacgccgaaagtcttcgcttgttttcgtttccgcctcatctggcgcgtcgttgcggagcataaacgacaaaggttaagaaccggaaaaatcacgggcctgataaggcaacgccgccatcggacatgttattgcccaatggcggcttcatgcgttattccgcatggtggtaaaaattacgcgtccgggtattcgcggataaagcgttccacatcgtcaaccatatggcggttgccgacgaagaacgagcggcgctggtgcaggctttccggaatgatatccagaatacgttctttaccatcgcttgctttgccgccggcctgttccgcgaggaacgccatcgggttgcattcatacagcagacgcagtttcccctgcggatggctggcggtgctggggtagagatagatgccgcctttcagcaggttgcggtggaaatcggccaccagagagccaatgtaacgtgaggtataagggcgacttgttgaactatcctcttcctggcagaatttgatgtacttcttcacgccattcgggaatttaatgtagttaccttcgttaatggagtaggttttacccttttccgggaaacgcatacgttcctggcacagacagaacacgcccaacgacggatcgtaggtgaaagcgtgtacgccgcagccggtggtgtaaaccagcatggtggacgagccatacacgacatatcccgcagcgacctgtttgttgccgggttgcaggaaatcttcttcggtgaccggcgtgccgacgggcgtcacgcggcgataaatcgagaaaatcgtaccgacagagacgttaacgtcgatgttagaagagccatccagagggtccatcagcaccacatatttcgcgtgttcgcagccttcaaagacgacaatttcgtcctcttcttccgatgcgatgcccgctacaatatcgcgcgcttttagtgcagctttcagtttctcgttcgcgaacagatcgagtttctgctgaacctcgccctgtacgttctcagcaccgctggcacccaggatatcgaccagaccggccttattgatatcgcggtggatgatcttggcgcccaattttattgccgacagcaaagcagtgagctcaccggtagcctgagagaactcgtgctgcttttcgacaataaattcacctaacgttttcataacactttccctgcaattgattggagtaaagcgaccgtaacaatcttaacaaacatttcagatgatgcgctcaggtgaatcgcgccagcaaagtacagatttacctgaaatgcgtttctcacttgccagacatgtgcgtaaaatggctcgcagataaaaaaaggatagtgacgtatgcgcattcatattttgggaatttgtggcactttcatgggggggctggcgatgctggctcgctcgcttggtcatgaagtaacgggttcggacgccaatgtgtatccgccgatgagtaccttacttgagaagcaaggcattgatctgatccagggttatgacgccagccagctcgatccgcagccggatctggtgattatcggcaatgcgatgacgcgcgggaatccgtgcgtggaagcggtgctggaaaaaaacattccctttatgtctggtccacagtggctgcacgactttgtgttgcgcgaccgctgggtactggcggtcgccggtacccacggcaaaaccacgaccgcaggcatggcgacctggatactggaagcgtgcgggtacaaaccgggctttgtgattggcggcgtaccgggcaactttgaggtttccgcgcgcctgggagagagcccgttctttgttatcgaagcggatgagtacgactgcgcgttctttgataaacgttctaaatttgtgcattactgcccgcggacgctgatcctcaacaaccttgagtttgatcatgccgacatcttcgacgatctgaaagcgatccagaagcagttccaccatctggtgcgcatcgtgccggggcaggggcgcatcatctggccggaaaacgacatcaacctgaaacagaccatggcgctgggctgctggagcgagcaggagctggtgggcgagcagggacactggcaggcgaagaagctgactacggatgcttccgagtgggaagtgtggctggacggcgaaaaagtcggcgatgtgaaatggggcctggtcggcgaacataacatgcacaacggtctgatggcgattgccgccgcgcgccacgtgggcgtcgcgcccgcagaagcggccagcgcgctggggtcatttattaacgcccgccgccgtctggagctacgcggcgaagcgaacggcgtgacggtgtatgacgattttgctcaccacccgacggcaattctggccacgctggcggcgctgcgcggtaaagtgggcggcaccgcgcgcattatcgcagtgctggagccgcgttctaacacgatgaagatggggttatgcaaggatgacctggcgccgtcgttagggcgtgcggatgaagtgttcctgctgcagccgccgcatattccgtggcaagtggcggaagtcgctgaagcctgcgtacagcctgctcactggagtggcgatgtcgatacgctggcggaaatggtggtgaaaaccgcacagcctggcgatcacatcctggtgatgagcaacggcggtttcggcggcatccatcagaaattgctggatgggctggcgaaaaaagctcagaacgtaacagcgtattaaatgactatgcggtcagccagccttgtggctggctgttttatatggggcatcttgccatcgaaagcgcattccgctcgccgggagacgttaaagcaatactgaaaaatcatttgccgctcagtattgaaaaagagtagacgcatatccttaaagtaatcagtgtaatacactaagagtgttccgccggttgccgtatgcgggacgaaaagagccagttcgcaataacagatgaaggtttcgtgatttataaacgtcatcttctgcctttcaacgtttgcgatgccgcctggctgcgggcatcgtccagtcataacaatgctgatcctgtcgcatttatgcggtcagattcagattgctcagaacccagcccgccagcaaattctgtactgaaggtaaccacagcgcaatttgaatgttgttaactgtatgttcagttcatttgtgctaatatggttatttacgaaattttcgttctattagagtatcatgcatgtctaaacatcaaactcaactttccttactgcaggatgatatccgcagtcgctatgacagccttagcaaacgtcttaaacaagttgctcagtatattctggataacagtaatagcgttgcttttgacacggtagcttccatcgcgcaacatgccgatgttcccccttcgacactgattcgttttgctaatgcgtttggttttagcggatttaatgaaatgaaacaggtatttcgccagcacctgatggaggaaacagtaagctataccgagcgggcgcgtctgttcagacagaaaaatgcggatgaaggggaacctaccccggaaaagccgggtgaaattctgaagctattttcaatggtgaatgcacaggtattacaacaattaccggtgcagattaaaaatgagcagttggatgcggcggtaaatctgttagcgaaagccgacaatatttatgtgattggattacgtcgttcgtttagcgtggccagttatttaacctacgcattgcgtcatctggagagacgggcatttttaattgacggtattggcggaatgttctctgaacagctaagtatggtcagccccgacgatgtcgttattgccatcagctactcgccttacgcgcaggaagtggtggaattagtcgagcttggcgcgaaacgcggtgcgcaccatattgcgataaccgatagccaggtcagcccgctggcagcgttcagtgaagtctgttttgtggtacgtgaagcgcaggtcgatggtttccgttctcaggtcgcgtccatgtgtctggcgcaaacgttagcggtttcactggcgctggcgacggagtaaaaaaacaagccgatgatcgtatttagcgatcatcggcattgtggtgaaacttaatcagaataacgttcggtttgaattggctgcagtttttttctgcgttttgctaacactacgctctccattttctccagcgaaatgccttttgtttccggcaggtaacggcagataaagaagtaactgaagatgcagcagatggcaaatatccacattggaaatgcgccgtggaaatgcgaaagtaaatacgggttttcattaatcatcgggaagaattgcgaaactaaaaagtttgccatccacataaatccgaccgaaatactcattccctgcgacctcatccggttagggaatatttcagaaataagcacccatgcgcccacgccccaggaaagcgcgtagaaaatcataaagaacagcataccgaatagcgcgaaataaccggttgcctggctgtacagcgcccatgaggtgagcaacaagccgatgatgctgccgatagtgcctttacgcatcagcgacaaacgccccatcttatccataatcattgcgccaataatggaaccgataagctgaatcacgccgatccagattgtctggaacagggcctcctgggcgctaccggtcacatccttaaggacgattggcgcgtaatacatcatgacgttaacccctgttacctgttgcagcatagcgatcatgcagcccaggatcaggatgaaacgcacgttcccgtcgcggtaattgagtttttgatgggcgtttagttggtcattttgcagtgaggtttttatatcggcaagaagatgtctggcatgttcttcgttggatattttggtcagtatttttagcgtctcctcctcgcgaccaatcatcatcatccagcggggagattccgggattaaaaagactaaaatacagaacaaaatgcagggaataatacccgcagcaaacatatagcgccagccaagttcaatgagccaggtatccgctgcaatcgatgctattttgtagttaacgtagaagatcagaatctgaccgaaaacgatagcgaactgctgcatacttaatgctctgccgcgcatgtttttcggtgagacttcagacatatacatcggtgatactgttgccgccaggccgactgccagtccaccgataatgcgataaatcacaaaatgggtgaacgtgtaggagagggaggtgcccactgcggaaatagtgaataacagcgctgaaaccatcaatgatttcttgcgtccaaaacgtttggataaatatccggcgctaaacgaaccaataacgcaccccaccacaacgcaggaaaccgcccagccggtctcagcaggagatagatgaaagtagctggtcagtgaaccaatcgcacctgaaataacagcagtatcgtagccaaataatattccgcccagtgcggcaatcgcgcagatgcgtaatatgtaacccgtattataacaactatctgatgtggacataggtagattatctccagaataaacttcatctatctgtttgaatttagtgaacaaatagacaaattcatcttatgtcggtcattgccgtagcgctgccgacgatcttatagctattgagaactctcgtttcacaacctatgttttaatttcaaaacgatcaataatgaaacttatgttttgttatgggtatcacatttcgaatttcataatcctggcgttttttatcgttaagatgctgcgttttacgcagtgctctcctctatcttgatgaagttacttgattttattgatttcgcgacagtacctgaactcaatttgtcaggggccgtactttttgttctttcctggaacatctccatttcgtgatcttttgcatggaatttttcttctaatgaatgcaaaaataaaatgaaaaatttcattggtgtgttgtttcctcaacaggcaagggagggattatgtctcagagaagtaagtacaattcggcctatgtgtacgtcctgtgttgtattgcggcgctggctggattgatgtttggttattcaacggcggtgattaccggagtggtattgcctttacagcagtattaccaactgacgccaaccgagaccggatgggccgtttccagtatcgtgattggttgtatcatcggcgcgctggtcggtggaaaaattgccgataaactggggcgtaaacctgcgcttctgatcattgcgatcatttttatcgcttcttccttaggggcggcgatgagtgaatcgttcatgatcttctccctttcccgcattgtgtgtggttttgcggttgggatggccggaacggcatccaccatgtatatgtctgaactggcgcctgctgaaattcgcggcaaagcgctgggcatttacaatatctccgtggtatctggccaggttatcgtgtttatagtcaactatctgatagcaaaaggaatgcctgctgatgtgctggtttcccagggctggaagactatgctttttgcccaagtggtaccctccattgcgatgttagcgattacgcttttcctacccgaatcaccggcatggtgcgcccgtaacaaccgcagcgaagctcgttcgataaaggtgcttacccggatctacagtggattaacggccacagatgtggccgctatttttgacagcatgaaagaaaccgtacgttcacaggacaacgtcgccgggggagaacgcaccaacctgaaaagctcgccggtgctccgctatattctgttggttggatgctgtatcgccgttttgcaacagttcacaggcgttaacgtaatgaactattatgcgccgctggtgttgcagaacagcagtaccgaagtggttatgttccagaccatttttatcgcggtatgtaatgtggtgggcagttttatcggcatgatcctgttcgaccgctatggccgtataccgattatgaaaattggtaccatcggctcaattgtcggcctgttgatcgcgtcatacggtttgtacacccacgatacaggctacattaccatctttggcatcctgttttttatgctgctgtttgccgtcagctggagcgttggcgcatgggtactgatttctgaggttttccctgaaaagataaaaggttttgggatggggctggcggtgagtctgatgtggatagccaacttcctcatctcactgttgttcccggtcataaatgataacgcctggctgcaggagaccttcggcggcgctttctcgatgtggatttttgtcgtctttaatttggtctgctatgtctttatttctcgttatgtgccggaaacaaaaggggtgccgctaacagaaattgaacggctggccgagaacaagctgcgtgaaattcaggggaaacgtcgcgatgtaatagcctgatacctctccaatattagcggagaatatccagagatattctccgctggttacacaacctttactccctccagcgagtgcgcacaggatataccctgttgaaacctccccagtgtttaccacctctacgtaactaattgatccataataatatcggcaaatagggtaagtcttcttctgcatcattattttattgcgtattcctggtgggggccgtgccgtaaatacgctatatacaaaacagggaaataatttaagagaaggcggatagcgatcttatgagcgtgtgtggcgcagagttgaataaaaaagccagccgcagaggacggctggcaaagtaccactcaacgaagtgttatcgcgggtagtctggtgagttaatccacgcgtggttctcttcccaggtgaaacgccattttcgtagcgggccggccatcacgttcagatagtagttatcgtaacccgcgatggtggcaaccgggtggtagcccttaggtactttcactacatcccggttatagaccgccatacattcatccaggctgcgatcgtcggtgtagacgcgctgtaagcagaatccctgaggtggattgaaacggtgatagtacgtctcttccagataggtctcctggccttcaactgccgtatcgtgcttgtgcgcgggccaggagctggtatcgccttcattagtgtacacttcaacgactagcaggctgtcggcgagctggctatcaggaaggatgttatgcaccaggcgctgattgcgcccttttccccgatgctctaccccgacctcttgtggcgagatcagacgtaccggaagctctccgaatcccggcgcgctgcatacggccagctcaaggtcggtttcggctgtcactttcgcctccgtatgatgggggaggtaaaccgaataagccggaatgcgttcaaacggactcatgcgctgaccaatccgatagaaaaaactgtcggcggccttaacgctggccagcccggcaaccagcaccagacagcgttcacgctcatcggacggcagggttatcgactctccagccttcaactgccagacatcaaaaccgacatactcccagcctgcattttgaggggaaatgtgttggatatttcccgactcagaggtacaggtactcagcaagttggccataatcttctccttcctgaaagcgtattaaccgagagtcggcatactgaactccgatacgatctgctgtccgttcggccaacgcgaggtaacggttttcatccgggtatagaagcgcacgccatccggcccatggacgttcagggcgccaaacaccgagcgcttccagccgccaaaagagtgaaatgccatcggaaccggaactggaatattaataccgaccatcccggcttcaaccgactgggcgaattcgcgcgcatagtgaccgttggtggtgaaaatcacgctgccgttgccgaattcatgggagtttaccgtgctaatggcggtggcataatccgggacgcgcacaattccgagaaccgggccaaaaatttcttcacgccagatggtcatctcaggcgtgacgttatcaaacagagtgccgccgacataaaagccttcaggatatcccgccacgctatagttgcggccatccatgaccagagttgctccctcgctcacccctttgtcgatgtaacccaacactttctgttgatgagcacgtgaaacaaccgggcccatttcattttcatctttgccgcgcagctctcccgggccgatacgtagcgccgcaatcagcggtttcaggcgttcgatcagacggtccgccgtttcatcgcccaccgcgaccactaccggcagcgccatacagcgttcgcccgcggaaccaaatgctccgcccataatggcgttgacggtggcgtccagatctgcatccggcatgacgattgcgtgatttttggcggccccgaaggcctgtacgcgtttgccatgggcgctggcggtggtatagatatgttccgcgacggcggaggaaccgacaaagctgacggcctgtacgcgagggtcgctggtcaacaggctagccgcctcattgccacagtgaacaacgttaaacacgccgtccggcaggctagcctcctgcagaagctgcgccatacgtaacgatgcggacggcaccagtgcgggcggtttcaggacgaaggtattgccgcaagccagagcaaccgggaacatccacataggcaccattgccgggaagttaaacggtgtgatgcctgccacaaccccaagcggctgcattaatgaaaagctgtcaacgcctgagccgacgttaaaggagtactctcctttgctgaggtgcgggatcccgcaggcaaattcgacaacctctatgccgcgcgtcagctcgccaagcgcatctgaccagaccttgccatgctcgctgacgatcagcgccgccagttcgtcccgatgcttttccagtaatactttgaattcaaaaaggatacgtgcccggcgtagcggagtcattttactccatgccggaaaagcctcatgtgcgctttgaattgccgccagcatctcctctcgggtgctctgggtgacctgacgaattactttaccggtggccggattagtcaccggtagcgtctcgccgctgctgctcagtgtcgttttaccatgaataaaattgccgactgtttccatctcttttttatcctcttaaaccgatgttgacgacgttctgactgagcggtcacaggaaagcctggttatcttcagcctaaaacgcataccgtattcaatgtaaattttaggattaaaaatttcaaatttatttttatgaaattttattttgaaagtttgacggctgatttttatacgagggtatgtgcagcaagaaatcaaaaatataattaacttattgatttttatcgtttttatttggtgtgtcatcaatggttgtctgttgtgacgaggaaagatttggaaaaaattatgatctatatagcatttttgtttcatttggtgtggtataaaaattcaaatttcaggggggtttcggcaccacagtttcggatattggagggtaaatcatgcgcttgtgcttctgtccttcagaacgagagaataaggctcagccccagttggcgtatgtgagtcaggtcagtgagagcaatggtccgtttgtccggttcatgcatatgcacccacagaccgttgaactgattcttatcaccgaaggagacggggagtatttcattggcgatcgcatctacccagttcgtaaaggcgacctggtcatttataacagccaggtggtgcatgatgagtatctggaaagcgggcggccaattggcactatttgttgtgggattaacaatatttcgtgtccgggtctacgtgagaatgcgctaataccggatgatattgtgccggttattccactgtatcaccattatgcgacggtggaaaaactgatgagctccgtgtttaccgttattaatcagcatgcggtagaagggccagcaatggcgcagctattgacccaggtagtactcaaatacattgagggaaatgtcttattgcgcacaggtaacgatgccatacagcgccatgaaaatttacttgattcaataaaatcctatattgatcgcaatttctatgagccaattcggctggatacgctggcgacgaaatttaatgtcagtccttattatgtttcccatgaatttaaacgccgctatggttattcaccgatggattacctgataaaacgtaggctgggggaggcgcaatcgttactaaccacggatgaaggcgggcgcgaaaagatcacctctattgcttatcgtgttggctttagcaaccttagtcattttcagaattacttcaaaaataaagtagggaaaacgcccggtcaatatcgcaaggactatcgtaaagctaattatttattatttgaatattaatgcttgctaaaatttaatcgtcatgagaatggtcgcaatactgcggccattttttatttgtcggtatattttatgcgtttatctatagcgcgaaaagtctggcaatatcattaaagagtgatgatttttttgtgatacctgacgcatttatcccacttcttcaaccaggatagataaagtttttcaggctacaaaaagtaatatgttgtccatcaaaggttaatttgcatcgcggtatgcagtaaaagcgtttcattaagtgggagccagcaatatgtacaatgtaaaaaagagcattaagttggggattgcgcctatcggttggcgcaatgatgatattcctgagattggtaaagaaaatacatataaacaaatacttagtgatgccgcgctcaccggtttttccgggacggaagttggcggttgttatccgcaggatcctgctgagttaaataaagagttaatgcttcgcggactggaaataccaggccagtggttttcttcctttattattcgcgatggtattgcatctgcgatgaatgcttttgaacagcattgtgcttatttgcaggcaatacatgcatatgtcgccgttgtttctgaacaaacttatagtattcaaggcattatcgataagtgcgtttatacagagaagcctaacttcagcgacagcgaatggcagcttttatgcgaaggacttaatgcgcttgggaagattgccaatgcgcacgggctgaagctcgctttccatcatcatatgggcaccggtgtgcagactctgccagaagtggatcgactcatggagaataccgatccgcaatttgtacatctgctgtttgataccgggcatatatatgtttctgacggcgatgtcatgccgctactgagtaaacattttgatcgtattaaacacgttcattttaaagatgtgcgtaatgaaaaactcaaagcatgtcgcctcgcgaagaaatcattcctcaattctttccttgatggtgtgtttaccgtccccggcgatggaaatattgattttaaatccgtattagcttatctggtcgggcatcaatattctggctggattgttgttgaggccgagcaggatcctaagaaatataacccattggaatatgcgcaaaaaggtaaaaagcatattgatgagttactgaaaaattatctttaattgaaaaggaaacagaaaatgactttaaaagcaggtattgtaggtatcggcatgatcggctccgatcacttaagacgtctggccaacaccgtgtcgggtgtagaggttgttgccgtatgtgatatcgtcgcgggtagggcgcaggcggcgctggataagtatgcgatcgaagccaaagattataatgactatcacgatctgattaatgataaagacgttgaagtggtcatcattaccgcatcaaatgaggcgcacgccgatgtagccgttgccgcgctaaatgctaacaaatatgttttctgtgaaaaaccgctagcggtgacggctgcggattgtcagcgtgtgattgaagcagagcagaaaaatggtaagcgcatggtgcagattggttttatgcgccgctacgacaaaggttacgttcagctgaaaaatattatcgacagcggcgaaatcggtcagccattaatggttcatggacgtcattacaatgccagcacggtgccagaatacaaaacgccacaggctatctatgaaacattgattcatgaaattgacgttatgcactggctgcttaacgaagattataaaaccgttaaggtttacttcccgcgccagtccagcctggtgaccactctgcgtgatccgcagctggttgtaatggaaaccacctccggcatcaatattgtggttgaagtatttgtgaactgccagtatggctacgacattcactgcgatgttaccggcgagaaaggaatggcggagctgccaaccgtcgccagcgccgcggtacggaaagcggcgaagtatagcaccgacatcctggttgactggaaacagcgctttattgatgcctacgacattgagttccaggatttcttcgatcgtctgaacgcaggattgccgccggcaggcccaacgtcatgggatggttatctggctgcggttaccgctgatgcctgcgtgaagtctcaggaaacagggaataccgagattgttgaattaccctcaaaacctgatttctacaaataaaccttccgcgtattaaaactcctgccggatagcgatgcttaagcgtcctatccggcatatcacaatttattatcttcttttatccggaacttccctatgaaaggcagactcatctcttccgatccgtatcgtcagcaattccttgttgagcgtgcggtctctttttcgcatcgtcagcgtgattgcagtgaattaatcagcgtcttaccgcgccacgcgttacagcagattgacggattcggcggcagctttaccgaaggtgcgggcgtggtattcaacagcatgagcgaaaagacgaaggcgcaatttctttccctttatttttctgctcaggaacataattacactctggcgcggatgccaattcagagctgtgatttttccctgggcaattacgcgtatgtcgattccagcgctgacctgcagcagggacggctctccttttcccgcgatgaagcgcatttaataccgctgatttccggggcgttgcggttaaatccacacatgaagctgatggcttcgccgtggagtccgccggcgtttatgaaaactaataacgatatgaacggtggcggcaagctgcggcgcgaatgctacgccgactgggccgatatcattatcaactacctgctggaataccgccgccacggcattaatgtgcaggcgctctccgtgcagaatgagccggtggcggtaaaaacctgggactcctgtctgtatagcgtggaagaggagacagcctttgccgtgcagtatctgcgtccgcgcctcgcccggcagggtatggatgagatggagatctatatctgggatcacgataaagatggcctggtggactgggctgaactcgcctttgctgacgaagctaattataagggaattaacgggctggcattccactggtataccggcgaccatttttcgcaaatacagtatctggcccagtgcctgccggataaaaaactcctgttttccgaaggctgtgtgccaatggagagcgatgccggtagccagattcgccactggcatacctatctccatgacatgattggtaatttcaaatcgggttgtagcgggtttatcgactggaatctgctgctgaacagtgagggcgggccgaatcatcagggtaatctgtgtgaagcgcccattcaatacgatgcgcaaaacgacgtgctgcggcgtaaccactcctggtatggtattggccacttctgccgctatgtgcgtccgggggcgagggtcatgctttcttcaagttacgataatcttctggaagaggtgggatttgtgaatcccgacggcgagcgtgtgctggtggtgtataaccgcgatgtccaggaaaggcgttgccgggtgctggatggcgataaagagatcgcgttaacgctgccgccgtcaggcgccagtacgttgctatggcggcaggagtcgatctgaatgatgaagctgggatttaatgaagcgacctgtatgcgaaactccacgctggcacaggatgttgtgttggcggaacgttttggctatgactacatcgaaatccgtctggatatgttgcaggagtggttgcagaaacatacgttaagcgagctggcagacattttcgccgtcggccaccttaagccctggggctacaattcgctggaagacattacgttttgtgatagcgaaagctgggcggagaaactgcggcagttggctttcgcctgccatgctggctcagtggtggggggtgattgtctggttgtggtgcccaccattcgtcaggggggaaattttccgccaggggaaacggtgaaagattcagtgaagcgtctgcgcgagatggcggcagtggcggaagaaagccggatgcggctggcctttgagccgatcggttccgcaggatgctgtgtgcgcagtcttgccatggcgatggagatcgtagatgcggtcgatcgcagtaatgtcgggctggtcgtcgatgcctttaatctttacctgcacgatcaatggcgggatctgaccacgcttcgccagatccctgtggaaaagatcttcgtttaccatattgatgacgccgataatctgccgctggcaacgctggagcattgccatcgtctgtttcctggcaacggcgtgatcccactgcatgagatcacgcatgagctagtgcagaagggctatgaggggatctgttcgctggaactgtttaaccctggctactggcagatggcggccagcgaagtctttgcgataggggcggaaaagactcgccccttcttaacagcttaatgttgccgcagcaagagatggacaaccgccgcgcccagcagcgcgcaggccgcggccagaagaaagacctgctgatagccgataaacggcgtcagcaggcccgctattggtccggtaaatccgtaggccagatcctgaaacgctgaccagacgccgagggccgtaccacgaatctccggtggcactctgcgcacaacctctacgcccagcgatgggaacatcagcgaacagccgcagccggtaatcgccgcgccaatcagcgcagcgcctgctgacggagcggcccacattaccgccagtccggtcccctctaccagtagtgaaaaggttgcgaccgtggcgccgccgtaacggtcgggaaatttggcgcagaaaaagcggacagcgataaacgcaatgccaaacagcgtcatcgcaaaaccggtgttatcccagtgacgctcgttgaaccagagggcggtaaacgcgcttagggtggcaaaaccaatgccctggagcacaagccctgttccgggccgccacaccaggccgactacccgtagcactggcacgcggggacgggctgttgggatattccccggaatgccatagatgactccgctggcgatgatcggcaacagcacgacgaggagcgccggaagcgccaggccggccctggcgtaaagcgacagccccagcggcgcgccgatagccagcgcaccgtaggtcgccatgccgttccaggaaataacctgacccgcgtgggtcgagcccgccagccacatcccccaggttaaattaccggtcaaaatgaaactttcaccgatgcccagcagcacacgaccaacaatcagtatggcccatgcgagcagcggaaccgggtgagcgattagactgaccagcatcagcagacctgatgcggcgcagtagaactgaccggtgataaccgtccgacgtccgcctgacgtgtcggcttttcgacccgcggcgccccgggtaagcaaggtggcgataaactggctgcctaccgcgataccgatcaacagatcgctcagatgcaactgctgctgaacgtacagcggcagcatgactaacgggatgccaatagtcagatagttgagaaacatcgcggcgctgatgcgaaacagcgtgatcgatgtggaatgttgtgtgagagctggcatggaatcgtccttgaacacgccccttgtccgatgcagacacggggcgtgatgaggcaggcattaacgtgccgggcggtattcgcgccagtagtcgataagcatgcggtatttttgtttcaccgttgcgatgagctgttcatcgttaagctggccgcctaaccactggcgtgacggttcgccaaagatggtccggccgacggcgaaacctttcacccagggcatatccgctgctgcggcgaatcctgacttcaactcgctttccggtgcgtccaggccaagtatcaatataccgcgacattcagggtcataatgctcaatatgctggctgatttctcgccaacgatctgggcttaacggcggcagtttccaccagtccggcaggatccccagttgataaaaacgttccacaatctgaggatagtattgctcattttggtctgccgcatcgcgcggcaagatgacttccagcagcagatcgtgaccagactggcagcaggcgcggtaaacctcgtcaatgagcgcctcttgttcaagacgtaccgactctgcatcgagtggatgatagaagaccagacatttcacgacgtgctcttgcggccagctgacaagctgagagccaatatcgccatgttccagcttcagcggatacgaaccgggcatctcaaccggtcggccaatccaccatccctggccggtcacgtcgttaagcgcctgctgaccaaaggtggtatcggcaaggatgccgctattattctgtaaaccggcctcaagcgccgcctgacgtgccccttctagcagtagcatcttcaggggggggatcgcggattcactggcgccgacttcatttgcgatatccaccagttgcttgcgatggtcaaaggcgaatacgcacagctccggccagtgctgtttacgggttgtgacccgatgaaggtgattcagccgcgggtctttgtctggccgggtgatggattgttcacgcgcgaggtagtcgtccagctcttttttggttggcatggcgggggcacaaccgtggcgcgataccactaacgcgccgcaggcgtttgcataacggcaggcttgctcccagctttcatcgttcaggtatccccgcagcagtcctgacataaaggcatcgcccgcgcccagaacgttcagaacgtctacgcgaacgccgctatgtatcttcacctgcgaccagtcatcggcgatgttgccttcaaagactgagcagcccagcgcgccgcgtttgcacaccagtacggcctgggtcaactgacggacgcgccgcagggcggtcagcgtgtcggtactgccgccggcgatatggaattcttcttcggtcccaacgatcagatcgaaatggcgcaatacctgctggagctgttcggtaacctgtgatgaggcgatgaaacgcgtttcaccgtctcctagcgacgtcaggccccacagtacggggcggtagtcgatatccagtgcccgccgcagcccgtgtttttgcgcatactccagcgctttaagaacggcggcgcgcgtattggggtgagaaagatgggtaccggtgacggctaatgcgcgtgaagaagcgatgtaatcttcgcggatatcctcaggtgttagcgccatgtccgcgcagttatcgcggtagaagatcagaggaaaggtgtcctgatctttaatgccgaggatcaccagcgcggtcagacgatcgcgatccgacagcaggcactgcgtatccacaccaacgcggtttaattcttcacgaacgaaacgtcccatatgctcatcgccgacgcgggccagcatagcggaacgtaatccctgaatggccgtgccgtaggcaacattgcctgacgatccccctaaatatttagcgaaagtcgtcatatcctccagccgtgacccgatttgttgaccatacaaatcaacggcgactcgtcccagacagataacgtccagcggcttttgctcactactgactgctttattcattgacatatcccctaacagaagacggtgttatttttgctcatactaaggtttggtgatttcattttcaataaaaatggaaataatgttttcatttattgtttgaacaagatcacagaaatggcatttccgggcaacgggcatgatcgttttttgttgtgttttttgttttaattgattgattataaatgtgttatttattttaaaatcgcatggaagataaatttcattttcatgaaaaatacgcctgaatgtcgaaattttttaaccgttttttgatctccttcccataaatgaaatataaattccatataattgtgagaacggaaattttgatcctatgataagtctctgtgtttttggggctgaagcgatgcataagcaggcaacgacagccgaacggttgataaaagcaggtggggtacatgaaaacaatcaggttgaccatggcgcaggctttggtgcgctttcttgataatcagtacatcgacgtagacggcagcgaaatcaaatttgtaaaagggattttcgccatttttggccacgggaacgtcgtcggattggggcaagcgctggaagaggactgtggccaacttagcgttcatcaagggcgtaacgaacagggaatggcgcatatcgcgacgggatttgcccgccagatgcgtcgccatcagatttatgcctgcacctcctcagtggggccaggggccgccaatatgatcaccgcagcggcgaccgcgacggctaaccgtattccactgcttttgctgccgggcgatgtgtacgcatcgcgtcaacccgacccggttttgcaacaggttgaacaagaacacgatttgacgctgagcaccaatgacgctttccgtgcagttagccgctactgggatcgcattacgcgtccggaacagctaatgagcgcctgtatcagcgcgatgcgggtgttaaccgatccggcggatacgggggccgtgacgctttgcctgccacaggatgtgcagggtgaagcctgggattatccggattattttttcgctcgccgggtctatcgtcttgagcgtcacgcgccgacggagccgatgctgaacgaggcggttgcgctgattcgccgccaccagcggccgctgatcgtttgcggcgggggcgtgaagtactcgcaggctgaagaggcgctgctgagatttgccgaacgctgtcatctgccgattgctgaaacccaggctggcaagggagcgctcagttctgcacacccgctgaacgtcggcgggattggcgaaaccggttcactggcggcgaatctgctggcgcaggaggccgatctgattatcggtgtagggacgcgctataccgatttcaccacctcctcaaagtggatcttccagaatcccgacgtgcgctacttaaatatcaacgttagccgctttgatgtcttcaagctggatggcgtacagatgcagggtgacgctcgcgtcgccctgacgcagcttagcgaacggctggcccaggagcattatgcttcgcaatggggtgagactattcaccgcgtccgctcgcaatatatggcggaagttgagcgcgtctatgctgtggaatatagcggagagggcttcaaacctgaaattgaggatcatatggatactcaaaaggtgtttgaagagtttaatgagattacgcggtcgtggctgacccagacgcgcgtgttgggtgtgcttaaccggatgttgccggaaaacgcgctggtggtggcggcggcgggcagcctgccgggcgacctccagcgtgtctggcaaagccgcggcgagaatgattaccacgtcgagtacggctactcctgtatgggctacgaagtcaatgccgcattgggggccaaactggcgcagccggagcgcgaggtgtacagcttcgtgggcgacggttcgttcatgatgctgcactctgagttggtcacttccgtccagatggggaaaaagattaccgtcattttgctcgataacatgaccaacggctgtatcaataatctgcaaatggaacacggtatggacagttacttcaccgagtttcgtttccatcagcaggagagcggtcgtcaggaaggcgggtttatcccggtcgatttcgctcgcatcgctgaaggatatggttgtaaaagctatcgcgtcaccaccattgaacaactgcatgaagcgttggaagatgctcgtaaacagaccgtgagcacgctgatagacataaaagtgcttcccaaaacgatggtgcataagtacctgagctggtggcgcgttggtggggcgcaggtatcccgtagcgaacgtatccaggcggtagcgcgtatgcttgaagaacatatcggacaggcccggcagtactgattaatttgccgtcgttcaggttgcagaagtgtggttattgttctgcaacctgaacgatacagcgtcaacgcattgtttgcttttcagaacggcaaaataaaacgatccgtttttcgcagaactacggatgcttttcttttgcggttttaaatttactattcatgagattaagaggtacgaatgaaaaagcttcgatgtggtgttattggcctcggtcgggtaggtaaaatgcatgttgagaatatgtatttactgcctcaattagatattatctgcgccgccgattattttattgaggagatgagcgattggctttattcggtaaatataacttcagggtataaaaattatcaggaacttttacagcgtgatgatatagaggcagtttttattttcacctcaacggatatgcacgaagagatcgtcacggcggcagcgcaggcggggaagcacattttttgtgaaaaaccgctcagcatgaatgaggatgagcaggcctcaatggcggtgctgagaaaagtgaaagagaagggggtgacgctgcaggttgcctttaatcgccgttttgatcctcagtttcacgaggtctttgagctggtgcgcagcggcaagattggtcggccccagatgataaaaatcacctcccgcgatccggacctgctaccccatgatctgatcaaacgtattggcggtctgatttttgacttcaccatgcatgactttgatatggctcgttttatgatgcaggatgaagtcagcgaagtctatgttaagggcaatacgctgattgatcccagcctgaaaaatattgatgatgttgatacgcttgcggtgatgctgactttcagaaacggcggctacgcgctcattgataacagccgtcgggcggtatatggctatgaccaacgggtggaggtttttggctcagaagggatggcgtatgcggataacgttagtgagtcgacggtgaaagttttcaacagccagcactgcataatgaaaaatccccttcctgatttcacggtccgttatcgcgaagcttaccgaacggaaatattacactttattgattcagtcctgcatcatacgccggttgtctgtaccggcgaagacgcattattggcccagcgtatcgctattgccgcgcagcaatcattaaaaagcgggctgccggtgaaaataacaagcgatatttatctttaactgcatctattaataatgaagaaactctcgcactgaaaagtgtgagagcttttctataccgaggataataaaatgaaagaaatgcaggcaacgctgccccagacattttatataaaaccaggtaagtttatctggagctacctgggaacatttttatttatgttgggcggctgtattgagaacagctggttatctgcctggttaaatacgcaggggtttgatcaggcgcatatcgggcagatttttgccgggtatgggattgtggtcgcgattacctcctggctatccggcgtctgtgtggacgtttttggtcctaaaaaggtgatggttaccggttttatcgtctatcttctggcttccgtcgcgtttctgaactttgcgctacccagccatgattttggcgcaattcttgttacctatatgctgcgtggcgtggggtatccgctggtctgttactccttcctggtacgcctgaccatccagttggataatcaccagcaagggatcggcacctcgctattttgggtggtctataaccttggttttaccatcattgggccggtggtggcggcgtcgttaattcctgagttggggcatatcaacgtgatgtgggccgggatgggcgttgcgctgctgggggttctcttcatgctggtgctggaacgcaatgaattcattctgaaaccgcgaacgacgccggtcttcaaagagttatctgcgggtatctccattatgtatgaacggccacggatcggtctggcggtgattgtcaaaactattaacggtcttggcacctatggttttgttgtcgtattacctctgtttctgctggataagcactttacgcttgaggaatgggcgagtatttgggggattacctttatctctaaccaggtcttcaacattatctttggctggatgggcgataaaattggttttcgccgaaccatccagatttttggcagcatcctgaccggtgtcgctacgctgattgtttactgggtgccgatgatatgggggcataactatgtcgcctttatgctggcgatgtgtttgtggggagccgggctggctggctttgtgccaatgacgccgctggtgccgatgatggcgccggataagaagggggcggcgaactcggccgtgaactttggctccggcctggggaatttcgttgggccagcgctggtctccgttctggcagggttcggcaccggcgtggtgatgtatactatggcggggctctatttattcagcggcatcctggtgcagtttcttaaagtgcctggcgagaaatagcttcaaatattcttcaaaaatcccttatagcctgtgatgttcatcactaaattaaaccggtttttatcaagattgataaagccggttttttcaccctacgttaaattgtactaacggattacggttatttacccactcatatacgttcagggagaaaataatgaatatcgaaaaaacacggttttgtattaaccggaaaattgcaccgggtctaagtatagaagcattctttcgactggttaaacgtcttgagtttaataaagtggaattgcgtaatgatatgccaagcggcagcgttactgatgacttgaattataatcaggtgcgtaacctggcagaaaagtatggacttgaaattgtcacaattaatgcggtctatccctttaaccaactgaccgaggaggtagtaaaaaaaacggaaggattattacgagacgcacagggagtcggcgcgcgggcattagttctttgtccgctgaatgatggaacgattgtgccgccggaggttacggttgaggcaataaaacgactgagcgatctctttgcccggtatgatattcaggggctggttgaacctttgggattccgcgtaagttcgctgcgttctgccgtctgggctcagcaactgatccgggaagcaggttccccctttaaggttttgctggataccttccatcatcatctgtacgaagaggccgaaaaggagtttgcgtcgcgcattgatatttctgctatcgggctggtgcatttgtccggtgtggaagacacccgaccaacggaagcattggctgatgagcagcgtattatgctgagtgaaaaggatgtaatgcagaattaccagcaggtgcagcgtctggaaaatatgggatatcgcggtatttacgcttttgaacctttttcttcccagttggcttcctggagtgaggcggaaatagaggaacaaattaatcgcagcgtgtcattgctgctgcaatgatacagctaatttccaggtgaccgttttcagtttccgcagcgtggtatttacaatgaaaattgcttttgatgtcgatgttattaaacatttacccattacccaaatggtacggcaggtttccgagtgggggtataaatatattgagcagtcgccgcacccgcgtattaatccgttttataaacaccctaaagctggtcgcgataccatgcaggaatataaacgcgccttgcagaactacggtgtggaaatctcgtcatttattgtggtttatcgttggtccggccccgatgaagagcgtcggcgcgccgcggtaaccaactggaagcggatgattgagattgccgttgatatgggcgtacaggtgattaataccgagctttccgggacgccggatgagccggagatttgtgaagagatgtggtatcgctccatggaggaattgctgccgatcgtggaacgagagggaattcgaatcgaaattcagtctcacccctgggatttctgcgaactgaacgatgagacggtcgacatggtgcagtctttgcgtagtgataacgtgacctatctgtacagcgcaccgcatggcttcttttacgataaagggcagggcgacgtcgcaaggatgctgaactatgccggggccgatctttcgcatgttctgctggccgatacgcacaaccacacgcttccctgccgctatatcatgaacccgcctggcgtgaatgcgacgattcatcagcacatcgggctgggagaaggtgaggtcgattttgacgcgctattccaggcactgcgtgaaatggattttgcaaaccgcacgtttaaggtgggcggtgaggcaattatcaccacgtcgctgtttggttatcctgagaaaatgagtgttcaggcggtggaaacgcgcgagcggatcgagcgggagctactcggacgttaaaaacgggtggatttgcctgtaccgcgccacaggctggcgcggtcatttgcggcaattacccttcgttttccgccagctcgcgcagatactggaagatctgacgcgctgatttcggcggtttgttgccttctttctctttcttcgcattgcggatcaatgaacgaagctgttgacgatcggcgtgcggccacagggtcagtacttcggctaccgcgtcatcgccttcgacgatcagacgatcgcgcagatgctcaagtttgtgaaacagcaccacctgctgattatggcggttcttcagcttgtccagcgcctggcgaataggttcaacgtcgcgttggcgcagcatttttccgataagctgcaactggcggcggcgtccttccattttgatacgctgggccagttcaatggcgtcgcgcagatcggcgtccagcgggatcttatccagcgcgtttttccccagatccaccagttccgcgcccaggcgttttaattcctcggcatcgcgtttaatttcacttttactgacccagataatttcatcgtcttcgtcttcgatgtcatcaccgggaacgtcgtcgagccagtcttcgggctgctttgtcatgtcaggctccttaaaaaaagaggctaatgttaccagttaagatgcgcactgaaaaacggttctctgttagacttcagagaaactctctctacattatggcatttgcaatgaaagtaatctcacaagttgaagcgcagcgtaagattctggaagaagcagtttcgacagcgctggagttagcctcaggcaaatcggatggggcggaagtcgccgtcagcaagaccaccggcattagcgtcagcacccgttatggtgaagtagagaatgtcgaatttaatagcgacggcgcgctgggtattacggtgtatcaccagaaccgcaaaggcagcgcctcttcgacagatttaagcccgcaggcgattgcccgtaccgtgcaggccgcgctggatatcgcgcgttacacgtcgccggacccgtgcgcaggcgtggcggacaaagaactgctggcgtttgacgcgccggatctggacttgttccacccggcagaggttacgccagacgaagccattgaactggccgctcgtgcggaacaggcttctctaaaggcggataaacgcatcaccaataccgaaggcggtagttttaacagccattacggcattaaagtgttcggcaacagccacggtatgttgcagggatattgctccacgcgccattcgctctcaagctgcgtcatcgccgaagagaacggcgatatggagcgtgattacgcttacaccatcggccgggcaatggcggatctgcaagcgccggaatgggtcggggccgagtgcgcgcgccgtaccttatcccgcctgtcgccgcgcaagctctccactatgaaagcgccggtcattttcgccaatgaagtggcgacagggctatttggtcatctggtcggggcgattgccggcggcgcggtataccgtaaatccacttttctgctcgactcgctgggcaaacaaattctgcctgaatggttaaccatcgaagaacacccgcatctgctaaaagggctggcgtcttcaccgttcgacagcgaaggcgtgcgtacggagcgccgggacattgtgaaggatggcgtactgacgcaatggttgctgaccaactattccgcccgcaaactggggctgaaaagtaccggtcatgccggcggcattcataactggcgtatcgccgggcaggggctgaactttgagcagttgctaaaagagatgggcaccggcctggtggtgacggaactgatgggccagggcgtcagcggtattaccggcgactactcccgcggcgctgcgggattctgggttgaaaatggtgaaatccagtacccggtaagtgaaattaccattgccggtaatttaaaagagatgtggcgtaatattgtcaccgtaggtgatgatattgaaacgcgtagtaatatacagtgtggttcggtattgttaccggagatgaaaatcgccggacaataatacccgtcatacttcaggctgcaggcgcgttggctgcctgcaacccgaattattcagggtattacacttatcgttaataataaaaaaggaagtgagcaatgcgtaaaagcctgttagctattcttgctgtgtcatcgctggtattcggttcggctgtttttgctgccgatcttgaagataatatggatattctcaatgataacctgaaagttgttgagaaaacggatagtgcccctgaactgaaagcggcattaaccaaaatgcgcgcggccgcgctggatgctcaaaaagctacgccgccaaagctggaagataaagcgccggatagcccggaaatgaaggattttcgtcacggttttgacattctggtcggccaaattgatggcgcgctgaagctggcgaacgaaggtaacgttaaagaagcgaaagcggcggcggaagcgctaaaaaccacccgcaatacatatcataagaagtatcgttaatttttgtgggatggcggcttcgctttatccgcaggtcgccatccggcaaactgtaatacccatcacactttctcactttatacgacaacgtcattgttttgccatttcctctttatgccgcgatagatctcacactttcccggcgataattcattaatgccgccttttctgtggcgcagatcacctatcccactcgcgtttccacttcgaggtggaaaataactcgctacaaacttttaacccttaccgctagttttatctcattgccattaacggggtgagacgcgtggataacggagcagtaaaacacgatgccggtgagcgaattaacgaactggctgaacaggtgttaacgcaggtggatggcctgctggggcggcatcacattgtccccaatgcggtacagacgcaaatgctgacctcgcacgttcgcgcgatggcgcaccggtcaattaccggcgagcctttaccggaagtcgatgccagcttgtttgatgaaatctcagccgaatcaatggcgctcgcccgcgaaatcgtggcggcgtttggcaaccttcctgacgaagaagcctggctattatcggtacattttgaagtcgcgaaagacaacctctaaggagcaaaaaatggaacagattaccgtcgtgattggcgatcgcctgggtaaaggccagaaagtggcggcaggcgtggaaaaagcgggcggtcgcgcggtcgtcgtgccgggcgtcgcggcagacatgaagctgggcgatgtgatgaaagcggaaaacgccaccttcggcatttcattttgcggcagcggcggcgcgggcgctatcaccgcgcaaaacaagcatggctacaaagccaaatatgggatgcggtcagtagatgaaggcgtcaccgctatcaatgagggctgcaacgtgttgggtttcggctttatggataaagaagagctcggcgagcgcctggtgcaggcgtggcaaaagaaatacggcgcctgatgatgaaagagcaattcaccaccacggtgagagtaaaaggcaagggcgacgccaaagcacgcgcctttgccgatgcgctgaaccatgttcagtcggcggtgatgagagagtcgccgtatatcttactgcgtattgagccacaggatgtgcggattgttcaggcgcatgagtcggtgcgtaaagaggcctttctgtttttctttttgcgccgggaacgacgcacttacagcgtggagctggatgtgaccgtcaacgtgaccgccatcaatctcgacagggtggatttcgtcgcgaaacgctgatttttattaaaaaggcatagttatgttcctgataatactaattaaatcgctcattatcggcgcgctggtcggcgtaggggtgggcgctggggctgcacgcatgtttcacgcgccaaccacgcaggggatgggcgcgttccgtacgttgggcgaactcaactcttgtgaaggcgacccggcatctcacttctcctttgggctgggtttcttctttaacgcctgggcctcgtctgtggcggccggatcgttcacccaggatgtcgatcaccgcatcatccctaactggggcgcggcggcgctaatgatcaaaaaccgtaacgtcggcgagacgctgcacgacccgaaaaaaatggcgatcgcctgcgccgtcatcggcatgatagtcgtgacgttccttaacctgaccgcctcatccgtgccagaagcgctacaggtgacggcggttaaggtgctggtaccggcggcaaacctgctggtcaacatcgtcatgcctgtgatcttctggttagcagcgatcgacgccggtaaaaaatcgggcttctgggccaccgttttcggcggcgcggcgcagctcatcatggggaacgccgtaccggggctggtactgggtattttgatcggtaaaggcgtagaagagagcggctggaaccatgttaccaaagtgatgatggtcgccatcgttttgctgtttgtgttgagcggcttcttccgcggcttcgacatgaaaatgatcgagtctttcaacatgacggtaccgaactggcttgaactgatccacaactcgctcagcggcaaataacggaggccacaatggaagagaataaaggtttttggtatgccgactggtcgttcccgatctttgttggcctgctctcctccggcgttttcgccgggacgcatatgtactatctgtacggcatcggcgcatttaacgaagtcgcttttgtggcgatgttgaaagcggggatggataccggcgtctacggcgcggtcgccgctttcggcgccagctttttatttgcccgcattatcgaaggttcgctggtcggaattctggatatcggcggggcaattcagaccggcgtgggcttaggggttccggcgttactgctgggggctggctttgtcttcccggtggcgaactttatcgcttcgctgataaccggtctggtgattggtctggcgattggctacatcattattctggcgcgtaagttcaccattaatcagagcgactccacgtacggggcggacgtcatgatgggggccggtaacacttcaggccgttttctggggccgttgattatcctcagcgccatgacggcatcgattcctattggtctgggctctctggtgggcgcgctgctgttttatatctggcagaagccgattactggcggcgcgattttaggcgcgatgatcctcggttccatcttcccggttgcgattagctaactgttgatttgtaggccggataaggcggttgcgccgccatccggcaaaggagagaacgatgtttgatttactcctgcgccatgcgcgtctggtcgatgacacgttgactaatattgccctgcaagatggcaaaatcgcggcgttgggtgacgttgatggtccggcgttgaaaaccattgacctgcgcggtgagtgttttgtcagcgcgggttggattgattctcacgttcactgctacccgacatcgccgatttaccacgacgaaccggacagcgtgggtattgccactggcgttaccacagtggtggatgcaggcagcactggcgcagatgatattgacgatttttacaccctgacccgtgacgcgaccaccgacgtttatgcgctgctgaatgtttcacgcgtcggacttattgcccaaaacgagctggctaacatggccaatattgacgctgatgcggttcggcaggcggtaaaacgccatccggattttatcgtcggcctcaaggcgcggatgagcagcagcgtggtaggcgttaacggcatcacgccgctggaacgcgctaaagccatgcagcaagaaaacggcaacctgccgctgatggtacatattggcaataacccgccggatctggacgaaatcgcggagcgtctgacggcgggcgatatcattacccactgttacaacggtaagccgaaccgtattcttcggcctgacggcgagctgcgcgcctcggtgacacgagcgctggcgcgcggcgtgcgtctggatgtcgggcatggtaccgccagcctgagctttgcggtggctaaacgcgctattagcctggggattttaccgcataccatcagttccgatatctactgccgtaaccgcatcaacggcccggtacattcgctggctaatgtgatgtcgaaattcctcgccatcggcatgtcgctgccgcaggtcattgcgtgcgtgacggccaatgccgccgatagcctgaatctgaaaaccaaaggtcgtcttcagcctggtctggatgccgacctgaccctctttacgcttaaacgccagcccaccgtgttggtagacgcggaaaacgacagcttacaggctgaagaattgctgacgccgcttgccgcgatacgcgcaggcaagggctatatgaccgaacaagggagcgcggaacatgccttcgatttttgagaagtatcaattaaaacaggtgattaacgcctccggacgtatgacggcgctcggcgtctctacgccgcgcccggaagtgatagacgcggcgatggccggaatgaatcagtatttcgagatgaaagatctggtgaataaaaccggtgagtacattgcgaaattgctggaggtggaaggggcgacggtagtctcctgcgccagtgcgggccttgcccagtcggttgccgcggtactggttcaggacagcgactggctgctggaaaatctgcacgttacaccgattgaaaataacgaaatcgtcctgccaaagggccacaacgtcaactttggcgcgccggtgggaacgatggtggcgctgggcggcggcaaactggtggaagccggttacgccaacgaatgttccgccgcgcagttggcggcggccattacgccgcgcacggcggctattctctatatcaaatctcaccactgcgtacagaaaagtatgctcagcgtggagcaggctgcggtggtggcgcgcacgcataatctcccgctgattgtggacgcggcggcggaggaagatttgcagtgctactaccgcgtgggcgcagatctcgttatctatagcggcgcgaaagcgattgaagggccgaccagcgggctggtgattggcaaaacgcagtatgttgagtgggtaaaacgtcagtcagcgggcattggccgggcgatgaaggtcggcaaagaaggaattgttggcctgacctgcgccattgaattgtacctgcgggcgcaaaaagagagcggcgcggagatggtagaaaaaatggcgccctttatcgacacgttgaacacgtttaacggcgtcagcgcccgcgtagtgtgggacagcgccggacgcgatatcgcgcgcacggaaattaagtttgatgaagccgttaccggcatcgccacaggcgaactggtcgacgcgctgaagcaaggggaatacgcgatttactttcgcggatacaaagccaacgaagggattattgaagcggatgtccgcagtgtcgatcgcgcgcagttagcgattgtggcgcgtcgtattggcgaggtgattaatcaggagaaacaagcatgaaactgacccctaacttttaccgcgatcgcgtttgcctgaacgtactggccggttcgaaagataacgcccgggaaatctacgcggcggcggaaggtcatgtgctggttggcgtgctctccaaaaactatccggatgtggcaagcgcagtcgcggatatgcgtgaatatgcggcgcttatcgataatgcgctctccgtcggactgggggcaggcgatcctaaccagtcggcgatggtgagcgaaatctcgcgtcaggtacagccgcagcatgtcaaccaggtgtttaccggcgtaggaaccagccgggcgctgctggggcaaaatgagacggtggtgaacggtcttgtctcgccgaccggcacgccggggctggtgaaaatttccaccggcccgctaagcagccgcgcgccggacggcatcgtacccatagaaacggcgattgcgctactcaaagacatgggcggcagctctgttaaatactttccgatgggaggactcacctgtcgcgacgagtataaagcggtagctgaggcctgcgcccgccatgatttctggctggaaccgacgggcggtatcgatctggaaaacttcgccgagattctgcacatcgcccttgatgcaggtgtaagcaaaatcattcctcacatttatagttcgattattgataaggtgagcggcaacacccgtgcggacgatgtgcgtcagttactcgctatcgtccggtcgcgtgtcggctaatcatgaggagagagacgtgcgattccccaaccaacgtttagcgcagctatttgcgatgctgcaaaacgagacgctgccgcaggacgagctggcgcagcggttgtcggtctccacgcgtaccgttcgggcggatatcgccgcgctgaacatgttgctgacgccgcatggcgcgcaatttactctcagccgcggcaacgggtatcagctcaaaattgatgatccggcacgttatcaatccctgcaaacgcagcaatctcccgccctggcgcgcggtccgcgcaccagccaggagcggatacactatttgctggcgcgttttttaacctccgccttctcgctgaagctggaggatttagcagatgaatggtttgtcagccgtgcgacgttgcagaacgacatggcggacgtgcgcgagcatttgctgcgttatcatctgacgctggaaacgcgtccgcgtcatggcatgaaattgtttggcggagagatggcgattcgcgcctgtctgaccgaccttttatggacgctggcgcagcaggagccctctcatccgttaattgttagtaccacgctgaacaccgaggtgtctcaacggctgcggtctcttttgccggatattttctctcattgtcaaatccgcctgaccgatgagggcgagctgtttctgcgtttatactgcgcggtggcggtacggcgtattcgcgaggggtatccgttatcggaatgcgtggcagaggaggtcgatgaaaaggtgcgccatgcggcgcatgagattgcggagctactacaacagctggctgacaagccgctgtcggagccggaagtaagctggctgaaggtgcatattgccgcccgccaggtacaggagattgcccccagcgccattaatgccgatgatgaagaggcgctggtgcactatatcctcaattttattaatacccagtacaactataacctgttgaatgataaacagcttcacgcggacttgctgacccacatcaaaacgatgatcacccgcgtgcgctaccagatcatgatccccaacccactactggaaaatattaagcagcactatccgatggcgtgggatatgacgttggcggcgatatcgagttggggaaaatacacgccgtataccattagcgaaaacgaaatcggttttctggtgctgcatattggcgttgggctggaacgtagttacaacattggctaccagcggcagccgcaggtactgctggtgtgcgatgctggtaatgcgatggtgcggatgattgaagcggtactggcgcggaaatacccgcagattgagattgccctcactctgacactacgcgactatgaggcgcgggacagtattgtggaggattttgtgatttccacggcgcggatcggcgaaaaagataagccggtcatcatgatcgccccctttcctaccgactatcaattggagcagatcggtaagctggtgctggtggacagaacccgtccgtggatgctggataaatatttcgatgcctcgcattttcgcatcgtggagggggaaatagatcaacagacgctgtttaaaacgctgtgcgatcagttgcacgaggaaggctttgttgatgcggcgtttctcgattcggttattgaacgtgaagctatcgtcagtacgttattaggcgacgggattgccttgccgcacgcgctggggctgctggcgaagaaaacggtggtttatacggtgctcgcgccgcaggggattgcctggggtgacgaaacggcgcacgttatttttttactcgccatcagcaaaagtgagtatgaagaggcgatggccatctacgatattttcgtcactttcctgcgcgaacgcgccatgacgcgcctatgcgcatgtcagaattttacgcaatttaaaacggtcgcgatggagtgcgtgagtcgtttttgagaggcgttatccagaattcgatgtaatgcgaatgtaatgctaaactgcattacacattcgattctactggaggcataatggccacgctgaacgtccgtctggatgacaaactcaaaaatgaggcttatgccgtgctggaaaaactgaacattactccaacggaagccgtgcgattactgttccagtacgtcgcggaaacggggcgcatgccagtgaaaaccgtcactcttagcgacagtgaagatgcattgattcagacagttcgggagaggctgtctagtccgcaaaagggaatcaaggttagtctggatgacttatgaactggaattcgacccgagggccttaaaagagtggcataagctgggcgatacggtgaaggctcagcttaagaaaaagttggctgatgtgctattgaaccccagaatcgactctgcccgtttaaacggtcttcctgactgctataaaattaagcttaaatcgtccggttatcgtctggtgtaccaggttcgggatgacgttgtgattgtgtttgttgttgcggtcggcaagcgagaacattcagccgtctatcacgatgcaaacaaacggctttagcgatcaacgcaaatgatgcactacctggttgctgctaccgcgccagataagcgccgggtctttcagatcctgcacaaatttgccatcgaccagcacgttgatgagatcgactacctgcatctgtgcggcgttgagttcatcgagcttgtagccggtccacacccagatatctttccccgggcactccgcgtggatgcgttgtaccagtgccaggatatccggtacgttttgcggatgcagcggatcgccgcccgacagcgagatcccctgacggtgaatgcgcgtgtcgttcagatcggcaatgatcttatcttccatctctttggtaaacggctggccggagttcagccgccaggtgcttttgttatagcagccagggcattcatgcacgcaccctgacacaaacagggtgcagcgggtgccggggccgttaacgatgtctacggggtagtattggtggtagcgcatagcgggtgtccagaaagcatgtaggccggataaggtgcttgcaccgcatccggcaacattgtgatgcctgatgacgacgcgattgcgtcttatcaggcctacggtctttgcaaacggaaattaacctatctgcccattgcctaaatgcttcacgcggcgcttcacttcttcctgcttaccggcgttaaacggacgcgcgtccgggctgcctaaataaccgcacacgcggcgggtgaccgagacgcgcgcggcgtcgtggttgccgcatttcgggcaggtgaaacctttactggtacattcgaactccccggtaaagccgcactcgtagcattcatcgatcggcgtgttggtgccgtaatacggtacatgctgatagctgtaatcccagacatcttccagcgctttcaggttgtgctgaatgttcgggtattcgccgtagcaaatgaaacccccgttcgccagcggcggatacggcgcttcgaaatcgattttgtcgtacgggttgaccttcttctccacgtcgaggtggaagctgttggtgtagtaacctttatcggttacgcccggcaccacgccgaactcggcggtatccagacggcagaagcggtcacagaggttttcacttggcgtgctgtacaggctaaagccgtagccggtctcgtctttccactgatccacggcctggcgcagacgctccacaatcgcgatgcctttagcgcgaagttgctcgctgtcgtacaggtgttcgccgccgaacagcgcgttaatggtttcatggataccaatgtagcccagagagatggacgcacgaccatttttaaagatttcagacacgtcgtcgtccgctttcagccgcacgccgcaggcgccttccatatacaggataggcgcgacgcgggctttcacgccttcaaggcgggcgatacgggtcatcagcgccttccgcgccagcgccagacgttcatccagcagtttccagaatgcggtttcgtcgccttttgcttccagcgcgatgcgcggcaggttaaggctaatcacgcccaggttgttacgcccgtcgtggatctgctcgccgttttcgttctcccacacgccgaggaagctgcggcagcccattggcgttttgaacgaaccggtgactttgaccacctgatcgtagttgaggatgtccggatacatgcgcttgctcgcgcactccagcgccagttgtttaatgtcgtagttcggatcgccaaacttgtggttcaaaccatcgcggatagcgaagaccagtttcgggaacacggcggttttgcgatttttacccagaccggcgatacggttacgcaaaatagacgcctggatcagacgcgactcccaactggtgccgaggccaaaaccaaaggtaacgaaaggcgtctggccgttagcggtgtgcagcgtgttaacttcgtattccagcgactggaaggcgtcgtagcactctttttcggtgcgagaacgcgcatacccttcggcatccgggatctgccactcatcggcggttttgcggtgcttgttgtagctttcggtgacaaacggcgccagcacttcgtcgatacggttaatggtggtgccgccataaatatggctggcgacctgcgcgataatctgcgcggtaacggcagtggcggtagagattgatttcggcggttcgatctcggcgttacccatcttaaagccctgggtcaacatgcctttcaggtcgatcaacatacagttgaacatcgggaagaacggcgaatagtcgagatcgtgatagtggatatcgccgcgctcatgcgcttgtactacgtcacgcggcaacaggtgctggcgggcatagtgtttggcgacaatcccggccagcaaatcgcgctgggtgggaatgactttactgtctttgttggcgttttcattgagcaacgcggagttagtttgctctaccaggccgcgaatttcctggttcagacgaccacgcttttcacgctgaatgtcgcgatcgtgacggtattcgatgtaggcgcgggcaagctgtttgtacgggccggacatcagttggttttcaaccgcagtttggatctcgttaatatccacctgactgcgcgcgttcatttggctgctaacgacttctgcgacggtggcacagtaatctgcgtcatcgactcccgctgctttagctgcacgtagaatggcttccttaatgcgctctgatttgaatggcactttacagccatctcgtttcatcacatgcggtgtcatgatcactccatatttgtaagaacaggttatccacagaggccggggaagccataacaggtttattcatctcttttccaacgacttcccgcaatcctgacccaggttatccacaattcaccttgtgtcgagtgaacaggtgttgtagcaattgtagtcaattaatacaacatattgggtcggtgtgcattttaaagtctatatgtagtgatttgcatcaaggatgtttgcaattttattgatgtagaacaaggtaaaaatcagagcgtacagatggcgggcgctgtagcgtttgtaaaagatagcaagaaaaatctgattaattattcaacaaaaacagtcagtaacctggagcaacgccacagcccgtgtcaataggtttgtggcgtttatccgtataaggatgtcgcgttagcgttgtaaccaccagatggcttcaaatgggcggagcgtcatcgcggctggctggctggcgacctcgccataattatgcagtagcgcctgccactgtcctttgatatgcggcggatgccactcctggcactggttactcagattggcgacaaccagcaggatttgcccctgccactggcggcgataacaccatactgatgggctatccgggaggagatcctgataatcgccccagatcagtacaggctgggttttacgtagcgcaatcagcttttgataggtgtaaaacaccgagttttcatcgcgtaatgccgcctcgacgttaacctccgtatagttatcgcacaggcttatccacggctcgccttgggtgaaaccggcgtttttaccgttgtcccattgcatcggcgtgcggctgttgtcgcgggatttactggccagaatagccagcagttcgtcggggtcgcgcccggcggcgcgtagcgcggcaaacatgttatggctttccacgtcgcgataatcggtgatgcgggtaaagtgtgggttggtcatgccgatttcttcgccctgatagatataaggcgtcccttgcataccgtgcagcgccatcgccaacattttcgcggctggaacccggtattcaccctcgtcgccaaagcgggaaacgatgcgcggctgatcgtgattacaccagaataacgcgttccaggcgacgttatgcatcccctgttgccagtggcggaacaacgctttcagcgccacataatcaggttttgccagcgtccacttttcgccattggggtaatccaccttcagatgatgaaaattgaaggtcatcgagagttcgtcgccgctaagcgcggcatattgctggcagttttccagcgtggtagaggacatttcgcctaccgtcatcagattacgcggcgtaaaaacgtcacggttcatttcgcgtaaaaacgtatgcgcgcgcggcccgtcggtataaaagcggcgtccatcgcccgtcggatcgtcaggaaaattctgatctttggcgatcaggttcaccacgtccagacgcaggccatccacgccgcgatcggcccagaattcgcagacctttttcagctcggcgcgtacggcggggttttcccagttcaggtcggcctgttcaggcgcgaaaaggtgtaaataatattgttcgctctggctatgccagcgccaggcgctgccgccaaatttggattgccagttattcgggcagacatccggcgtgccatcgcgccagatataaaactgacggtatggactctctttgttcagcgcttcgcgaaaccaggcgtgctgggtagaagtatggttaaacaccatatccaggatgatacgaataccgcgtgctttcgcctgcgcgaccagctcgtcaaaatcatccagcgtgccgtaggtcgggtcgatagccgtataatttgcgacgtcataaccgttatccacctgcggcgagatataaaacggcgtgagccagatggcgtccacgccgagtcgctgtagatagtcaaggcgctgcgtgacgccgcgtaaatcgccggtgccgctgccggtcgtgtcctgaaaactttttgggtagatctgataaataacgccgttttgccaccagaggggaatagtcattgttgtttcctgcaagtgcgttgggacgcaactgcgccccgaagaagtattagacaatttgtaatgtgccctgacgatgcttacgctgatagataaaggtggtcagaatcaccgggatcacgatcgcgataaccatcgccatgccgtacacctgccagtagcgcggcggtatagacaggatgcccggcaggccgcccacgccgataccgttggcgatgacgccgttcagaccgcagagcagtcccgccagaccagatccgatcatcgcgcacagcatcggaaaacgatacttcaggttgataccgtacatcgccggttcagttaccccaaggtaagcggaaatggcggcaggaacggagatctcgcgttcattgtgtttacggctggagatgatgatgcccaccacggcggaggcctgcgcgatattcgacagcgcaatcagcggccagactggcgtaccgcccatgctctggatcatctgcatatcgatagcgagcgttgtctggtggacaccggtaatgaccagcggggcatacaggaagccgaacagcgccgcgcctatcggggcgaaactgccggtcatcagataacgtaccgcaaaggccacgccgtcgccgatcatacgaccaaaggggccgataaaggtgtgggcgagaaagacggccagtattaacgaacacaccgggacgacgaccaggtagagataatccggcacgatgcgtttcaaccgcgtttcaataaatccaagcgccagccctgccagtagcgccgggataacctgcgcctggtagcccactttctcaatgctaaataagccgaagttccagacgtccggcgtttgctggcccagcagatacgcattcatcaactgcggcgacaccagcgtcacgccgagcacgataccaagaatcggcgtgccgcccattttttcaccgccgaccagcagattcccaccggcagatagaaaaagatcgcttcgccgatcaaccataaaaaatcataaagcgtttttagcgccggatgcatctgcgccagcgtttggccgttgctcatcggcacatcgccgatcacgttacgaaagcctaagatcaaaccgccgctgatcaacgccggtagtagcggaaagaagatctccgcaaagtgggaaattaactgctcatgccatttcatgttctggcgagcggcttttttggcctgctctttatcagcatacgctttgccggtggtctccagcagcgcgttatagtaatcgccaacgtcggtgccaatcaccacctgaaactgaccagcgttggtgaaacaacctttaaccatcggtaattgttcgatctcttttggcctggcgttcgcgggctggtggagcacaaagcgcaggcgagtaatgcagtggctcaccgtggcgatgttgtcgcgcccgccgaccaggtcaatcagccggtcgatatcggcttgttttactttgctcatcgtaaagcctcatggcagaggagatatgttatgggttggcgcaagagtagctcttcaacgttggtttaaaaatgggaacgttcccgaaacgcagcgacgatcacaaattactcgtggtattccgtttaattagtcactcaggcgagggtagaaggaatgacgatccggcgcggatcgcagcggccattgatctgttcgatcagctgcgaagccgcctgtcgtccggcttcagcatagccaggatcgacagtgacgatctccgggtgcaggaattttatcagcggcgtgttcccgacgcttgccagttgcagcgtctcaatacgttgctcctgtaaatacttactggcgcccaacgccagcgtatcggtggcgcagactaacgcggtggtatccggcatgatgacgcttgccgtatgctcatagccctgcttcatggcaagaccgggcagggcggcgacggggtgaagtttatgttttttgcaaaacgccaggtatgcgtcatgccgacgtttgccggtggtaatatcgctatggggaacgcccagaaagctaatgttgcggtgtccctgctcatacagccgctgcataaggatatgaatcgcgccctcgtcgtcgtaacagacggaggcaaaaccttgcgcatctcttgccagcagcaccagcgaggctttccagggggcgatcaactcttctgtgatgccggtaaagccaaacagcaccacgccatcaatgttacgtcgtctgagcatgcccagatgttccattaccagcgtcggcgagaactgactttccatcataatagggtcgtagccctgttcgtaaaacgcaggcagcatggtctgaaccgcgaggttttcagacaacgaatcaaggcgagtgacgataatagcgaccactttatcgctttgtccccgcatcgcgcgggcggagcgggacggggagaaaccgtgttgattcatcaccgcttcgacacgctcgcgggtacgttcgcttacgccgctttcattgttaagcacgcgggaaacggttgatttccctacgccgctcaggcgggcgatgtctttgatagtgagccggttttgcatcctgttttcccgtggcgtgacgctgatggtgataaaaagagtaactttactcaagcgaagggcaatgggcaaagtctggtttatcgttggtttaattacgtaacggtatgataccgccataattgccacaaaacttatggatttatgcgtataatccgcggcgcaaattatttacttaccggaggcgacatggaccctgaacccacccctctcccgcgatggagaattttccttttccggtaagcctgcctctgctgtcttaccggtgtgtaagacagtgacacaataacgtccctgtttttatttaaacattgctcatcgggcaaggctttgccgtgcctgaagaattttctgcgcctgacttcggcgcggagggattacctatgctaaaaatcattacccgccagctttttgcccggcttaatcgtcatttgccttatcgtctggttcaccgcgatccgctgcccggcgcgcagaccgcggtaaatgcgactatcccgccttcgctgagcgagcgctgtctgaaagtcgcggcaatggagcaggagactctctggcgcgtttttgatacgcacccggagggattaaacgctgccgaggtgacgcgcgcgcgtgaaaagcatggcgaaaaccgccttccggcacagaaaccctcgccgtggtgggtgcatctgtgggtatgttatcgcaatcctttcaacatcttactcacgattcttggcggcatttcttatgccacggaggatctgtttgccgcaggcgttatcgccctgatggtcggtatctcaacgctgctgaattttgtgcaggaagcgcgctcgacaaaagcggcggacgcgctaaaagcgatggtgagcaataccgctaccgtactgcgggttattaatgaaaatggcgaaaatgcctggctggaattacccatcgatcaactggtgcccggcgatattattaagctggcggcgggggatatgatcccggcggatttacggattatccaggcgcgcgatctgtttgtcgcccaggcgtcgctgaccggcgaatctctgccagtcgagaaagtcgccgcgacgcgtgagccccggcaaaataacccgcttgagtgcgacacgctgtgctttatggggacgaacgtcgtgagcggaacggcgcaggccgtggtgatggcgaccggcgccggcacctggtttggtcaattggcggggcgcgtgtcggaacaagataacgagcagaacgctttccagaaaggaattagccgcgtcagtatgttgctgatccgctttatgctggtcatggcgccggtagtactgattattaatggttacacgaaaggtgactggtgggaagcggcgctatttgcgctctcggtcgcggtagggctcaccccggaaatgttgccgatgatcgtcacctccaccctcgcgcgcggggcggtgaagctctcgaaacagaaagttatcgtgaagcaccttgatgcgattcagaacttcggcgcgatggatattctgtgcactgataaaaccggcactctgacgcaggataaaattgtgctggagaatcacacggatatttctggtaagcccagcgagcatgtactgcattgcgcctggctgaacagccattatcagaccggtctaaaaaatttactggatacggcggtcctggagggagtagacgaaaccgccgcgcgtcagctctccggacgctggcagaaaatcgatgagatcccgtttgattttgagcgtcgccggatgtcggtagtggtcgccgaagattcgaacgtgcatcaactggtctgcaaaggcgcgttacaggagatcctgaacgtgtgtactcaggtgcgccacaacggcgatattgtgccgctggacgacaatatgctgcgccgggtgaaacgcgttaccgacacgctgaaccgtcaggggctacgcgtggtcgccgtcgcgaccaaatacctgcctgcgcgtgagggcgattaccaacgtatcgatgagtctgacctcattctggaagggtatatcgcttttctcgatccgccgaaagagaccaccgcgccggcgctgaaagcgctgaaggcgagcggaattacggtgaaaattctcaccggcgacagcgagctggtagcggcgaaagtttgccatgaggttgggctggatgcgggcgatgtcattattggcagtgatattgaagggttaagcgacgacgcgctggcggcgctggccgcccgtacgacgttgtttgcgcgtctgacgccgatgcataaagagcgcatcgtcactttactcaaacgcgaggggcatgtggtcggttttatgggcgacgggattaacgatgctccggcgttgcgggcggcggatattggtatctcggtagatggcgcggtggacatcgcccgtgaagcggccgatattatcctgctggaaaagagcctgatggtgctggaagaaggcgtcattgaaggtcgtcgtactttttctaatatgttgaaatatatcaagatgacggccagctcaaatttcggtaacgtgtttagcgtactggtggcgagcgcctttttgccgttcctgccaatgctgccgctgcacttgctgattcaaaacctactgtacgatgtatcccaggtggcgattccgtttgataatgtcgatgaagaacaaattcaaaagccgcagcgctggaatccggcggatttggggcgctttatggtctttttcggtccgatcagctcgattttcgacattttgaccttttgtctgatgtggtgggtatttcatgcgaatacgccagaaacgcaaactttgttccagtccggctggtttgtggtgggattactgtcgcaaacgctgattgtgcatatgatccgtacccgccgtctgccgtttattcaaagtcgcgccgcttggccgctgatggcgatgacattgttggtgatggtggtgggagtctcgttgccgttttcgccgctggcgtcttacctgcagttgcaggcgctgccgttaagctatttcccgtggctgattgccattctggtgggatatatgacgttaacccagttggtgaaagggttttacagcagacgttatggctggcagtaaacactttcgtcggggattcgccagcgtgcttaatccccgatatcgctaaccaggccagatgcccgtaaagctcgacaagtttaacgcgatcggctttatctttaaatttcagggcttattcaagcaactgtagaatgctatatgcaggcataaaaaagaggaatgtccagctaagtttgtaaaatacattctctgcccccgagccagaacgagaggaggagatgtcccaccgccggatatgttttgcggatatgcgacgaaagcggcgaatatagctaatgcaataaactaagtaaggaggaatcgctaaggcggcagtgggtttaggaaacataagggtaagcaatatggctgcgacaatgaagcataaaaagactatcttcgcggtagattctatctgttttaattcctggcgtatgctttcagcatgtttctcctgccagcgacggagcgtgctgttgctaaatccatattcttcgcacaacgccttattcggtacgccgtttttcgactgttgcagaaaatcggcgatttgttcctcggtaaaacgcgatcttaccattgccgcctctccatggctgttggtgccccgaaccgggcaaacttgcgccgcccggcggggatgacgtccggcgcttagcgacgaacagcgatcgcttcaatctcaattttcacgtctttcggcagacgggcaacttccacgcaggaacgcgccgggaaggtggcgttgtgctcggtgaagaaggcttcgtaggtggcgttgacggtcgcgaaatcgttcaggtctttcacgaatacggtcgttttcacaatgtcgcctactttcaggccagcggcttccacgatagctttaacgttttccagcgactgacgtgcctgagcggatacgtcttccgctacggcaccggttttcggatcgaccgggatctgaccggaagtgattaccatgctacccaggtcaacgccctgtacgtatgggccgattgctgctggtgcattttccgtcgcaatagttttgctcatgatttctcctgaattacagcggtaatagaatgtccccgctcattatagggagccgggatctcataaccaacccaaattagttggccagcaccacataatgcgaaaactctttttcacagtatttgcatttgagggcgatatcattggcgcgttttttcactgcaaagctggaggatactggttccgcgtggctgatgcagttgctgttcgggcaaaccagcacattattaatacgctctggcaggctggggcgtgatttcccgactacgtcgtagttgtcgatgcggttaacggtggcctgcggcgcgtacagagcaagttggttaacctgctcttcggtgagaaaggtgttttctattttgattaagtctttacgccccatctcgccagacgggagattcagaccgatagtgattcgctgatcggtctcggtcaatttaaacagactcagcagtttaaagcctacctgcgcagggatatggtcaatcacggtgccgcatttaatggcttcaacctgcagtttgttatcgtgtgtcatcgtttttctcccttacagactcagttcgctattcagtactaacgccagtaacgcctggcgagcgaaaataccgttgcccgcctgttggaagtaccaggcgtgtggcgttttatccacatccgtggtgatttcatcaatccgcggcagcgggtgcagcactttcatattttcacgcgcgccgttcaggtcgctggcgcgcagaacaaactgcgccttcacattggcgtactccgacgggtcgagacgctctttctgtacgcgagtcatatagaggatgtcgacgtcggccatgacctcttcaatagaaccatgcaggctccaggccatccctttttcatccagcatatccagaatgtactgcggcatcgccagcgcgtccggcgcgataaaataaaaacggttgccgctaaatttcgccagcgcctgggttagcgaatgcacggtgcggccatatttcagatcgccgaccatcgcgatatgcaagttatccagacggccctgcgtttcctggatggtgaacagatccaacagggtctgtgtcggatgctggttcgaaccgtcgcccgcattgagcaccggcacctgaccggaaaactccgtcgccagacgtgccgcgccttcttgcggatggcgcatcacaatcgcgtccacgtaagtgctaatcactgagatcgtgtcggctaacgtttctccttttttccccagcgacgtgttggcgctgtcggagaagcccactacgctggcgcccaggcgatgcattgaagtttcaaacgacaggcgggtacgcgtggaggcttcgaaaaagcagctggcgatcactttatgtttcaaaagctccggctgcgggttggcttttaatttcgccgccgtcgccagtaccagattaagatcgtcgcggctgaggtcgtttatggaaatgatatgtttttgatatagcgggttagccatgtttatctcctgacgcctgggcaaaaaaaaacccctcaattgaggggcttggtattggttttcaacggaaagaaaaacggcaggcctgcgtcttttttcagacgcggtaagacagaatgtcgtacacactgaaccatgcttcctcccggcaaattgtccgcgattatactcagctctgttttgggatcaagcgattaatgcatgatttactcatcgcaaacggttcttatgaatttaaattcattttaagcaaataattaatttgtttgtgtaccagcgccgtgcgctgaacgacccgtggtgcgacccagacaatactgctaccggcaacgacgccgagaatttccggcaatgcgtggtaatccagaattctcgcgacggcgcgaccataacctgccgccgtatggataaggataaattcgctattatgttcaacgctaacgaccatttcggctattgaacgtccggcatccggcgaaggtcgccgctggggatttacggaataaatcttttgtcccttcgtatttctgatttttattgcgcccagcagcttgagcaggcgcgaaaccgtagactggctgataccttcaaatccctcattttgtaaatcgcggcgaatctcctcctgggacaggtaacttttttcactaatcaggcgctgacaaaccgccagttgctgttgttctttggcggagtaatcatcgtattccttcataaatgcaccttatctttattattgatatcaacggactggcgaaattcatcacatttgtcacatcgattgcggatcaatcgggcggttttgcaggaaaatgagaagccgatcaaaaaaggtgacggcgtgcctgatggcgctgtgcttatcagtcctgtcagataagacgcgtcgccatctggctcgttacatcatcgctccgatgctcagtaccgccatattcagcaatgtcaggatcagcaacagcggggcgacccatttcagatagcggacatagggaacccgcgcgatcgccagaccgcccatgaccacggcggaggtgggcgtaaccaggttcacaatcccggaggccgactggtaggcggttacgaccaaatcccgctgtacgtgggcaaaatccgctaacggcgccataatgggcattgtcaatacggcaagaccggaagaggagggcaccaggaaggagagcaatacttccagccagtaggttacgtttatgaaaatagtggtagagaggccggaaaccagactttccgcgctgtgcaaaatggtgtgggtaatcataccgttatccatgaccaccacaatgccgcgcgcgataccaataattagcgccacgccgagtaaatcccgcgcgccgtcaataaaggtactggtgaacgcttcctcacccatccgcgttatcacgccaacgataatcgccgccgccagaaagacgccggagatttccgccatccaccagccgagaaccgccacgccgtaaatcatcaccgcgaaagaggcggcgaagatcatcagcacccatttccgggtagccgtaaactccagcagagtattggctcgattgccgaggaaatgggcgcggttttcctccattttatctgccacgatagaaagctcaggatgggcgcggactttgcgcgcatagcgcattacccaaaacacgcacagtacgtagccgacaattaacagcagtactcgcatcagcattccctgagtaaaagggatgccggcggcgttggcggcaatgaccgtggcgaaagggttaatggtcgaaccgagcgtgcctatccccgcgccgagcagtacggttgccgcggccactaacggatcgaagcgggccgccatcataaccggcaccagcagcgtgtagaagggcaacgactcctccgccatgccatagatagtgccgcctgcggcgaacagcgccatcagaatggggatcatccactcatctttgccgttgagtttgatagttacccgttcaataccggcatcaatcgcccccgttttattcaccacccccagaaagccgccgataatcaagacaaacagcgcgacgtcaatggcgccggcggtgtaggtttcgtggttatagaggccgtcaatcggcgccagtaaaacagcggtaatcccttgcggatgcgcgtccacgggggcatacgttcccgccaccggcacctcttttcccagcgtggcgttcatcgccatttggtattttcccgccggcacaatccaggtcatcactgcgaccagggcaataagaataaacaggatggtataagcggtgggaaatttaaatttacccatgatgttctctcctgatatcacggatatgcgccgcgagggcgcatatcctgtgggattagtcgccgagcgtcgccaccatgactgctttgatggtgtgcatccggttttccgcttcatcgaagactatcgagcctgcggactcgaacacctcttccgtgacctccagtcctttcaggccgtaagccatttcgatttcgcgtcccactttggtgtgctcgttatggaaggcgggcaggcagtgcataaacttcacatcaggattaccggtagcgtttaccacctgctggttgacctgatatggcgtcatcagactgacgcgctccgcccaggcttctttgggttctcccatcgagacccagacgtcggtatagaggaaatccacaccgtgaacgccgtcttcaacgctctccgttaaggtgatacgagcgccggtaacgctggcgatttctcggcactgcgcgaccagcgcggcatcaggccagaaggactttggcgctatcagacggatatccatgcccatcttcgccgcgcccaccatcagcgaattgcccatgttgttgcgcgcgtcgcccaggtaggcgaagctcagttccggcagcgttttgcccggcgcatgttccagcatggtcatcagatcggccaggatctgtgtggggtgaaattcatcggtcaggccgttccagacgggaacgcccgcgtattcccccagctcttccacaatgtgttgaccaaatccgcgatattcgatgccgtcatacatccgccccaggacgcgagcagtatctttcatggactctttatggccgatctgcgagccgcttgggccgagataagtcacctgcgcgccctggtcgaacgcggcgacttcaaacgcgcatcgggtgcgagtagaggttttttcaaaaatcagcgcgatgtttttgccgatcagtgtttgcttttcgcatccggctttttttgcggctttcagctcaatagccagatcgatgaggtgttggatttccgccggggtgtagtcaagcagcttcaaaaagttacgatttttcagtgaaataaccattacaatatccttgttaaaatgaattgcctgatggcgctgcgcttatccggcccacggttatgcgcgctctgtaggccgaataaggcggaagccgccatccggtaaaaagccttatgcgtcaacgtcggcggtttcacaccgaatcaaagtacctttctcgcccgcgagaatggcttgcccatccgccagcgagccgattccggcaatgccgcggcaatggctgacaaactcagcgcaggcggtcactttcgggcccatcgaaccggcgtcgaactgcatttcacgaagcagctccggcgtaacctgcgccagcgggcgttgggtgggcttgccccagtcgagatacaccgcgtcggcatcggtcagaatgagcagcgcgtcggcgtgaatttggctggcaagcagggcggcggacagatctttgtcgatcaccgcctcgataccgtggtagccatcggctttttccacgaccggcacgccgccgccgccgttacagataaccaggtgatcgcggctaatcagcgcgcggatggcatcgttttccacaatgcgtttcggctgcggggagggcacaacgcggcggaaggcgttaccgtcggctttgaatacccagcccttttctgcctgtaacgcacgggcctgcgcttcgtcgtaaatcggtccgatatatttggttggattgaggaatgccgggtcgttggcatcgacttcgacctgggtgagcaggacgctgatttcacgctccggcagatgattcttcagcgcctgttgcagcatgtagccaatcatgccctggctttccgcaccgagaatatcgagcgggtagggtgtaacgttagcgtaggcgctattttgtagcgccagcagtcctacctgtgggccgttgccgtgcactaacaccacgcgccattgccgcgtaagctgggcgatggttctggccgccagttcgatatttttacgctgaatatcagcctccagcggttcgccgcgtttgagcagcgcattgccgcccagcgcgacgaccagtgtgcgtttgttttccataacgtctcctttaaataccatcgcgttccagtggacagctcatgcagcgtgcgcccccgcgcccgcgacccagttcatcgccgggaatgggaaggacggtaatgccggctttgtcgtatttttcgttggtccagatgttgcgctcatagcccaccaccacgcctggacgcagggtgagcacgttattggcgtcattccactgttcgcgctcagcttcaaatgcgtcgccgccagtggtgattaagcgcacctgatcgatgccaagcgctgtttcaagagcatgaaccagcgtgctctcctgggttcgtttcagaccgccgcgtccgtctggcgtcagcgtccagcactgaacgtccgggcgaacgacttccggatagacggagaaggtgtcgatatcaatgtgggtcatgacggtgtcaaggtgcatacaggagcgatgttttggcagttcaacggcaatgacgcgttccgcctgacgatgtttaaacaatgcctgcgccaggaactcgacgccctgcggcgtagtacgttcagacataccgatcaacaccgcgccgcggccaatcaccagcacatcgccgccctctaaagtggcgtggtcgtaattaatgtcctcgtcgccgaaatatttaatgaaatcaccgcctgcgaattgaggatgccagcgataaatggcacgtaaattattcgtttcacgttggcgtgcaggtttcgccatggggttaattgagacgccgttatatatccagcaggacgtgtcacgggtaaataggtgattcggtaatggcttcataataaagtcattaatatcgtgagtatcgaccaccatattttttatggaggcgggaatttcgccgtaagttaaaccgccgcttaaatggcgagccagttcacggtgcggcatatccgccagccaggcgcgaatatctgcggcaaaggtgggcccaaggcgataatcggaaatttgcgtatccagtagccaggctttagcgtcagccacatccagcgtttgggtgagcaggtcggttaacagcaacacttctatcccttgctggcgcagcgtgttggcaaaaatgtcatgctcttcgccagcgcgctctacggataatacatcgtcaaaaagtaattcctgacaatttgaaggggtaagtctttttaggctgagattgggccgatgcaacattacgctgcgtaattgaccgatttcagaaccgacaaaatgcttttccatcattataccttttacataattacaagaataaagaaggagtggctgcaaatatttagcgtgcttgcagtcgcggcgtttcagttaaattcgggagcaatgattgaattttatttgggttgttaatgtgatgagattcacatcaatcaaggagtgctatttttcttacttaatatatgaaccgggtcagagaaattcaaaaaacaataaggcattaaatgaattactacgcagctatatggtttgttatttttctattgttaattatttgtttgctgtattgaatgatatttaaatcttaactcattgaaaataaagtgattatttttaatggttgcataactatgcgtgagggggattttattatcggggatatttaaataatttaaaaataactatggatagagaagtcatttatgcagggagagcgaattgtgatcgctaaaacgtttttatgttaacgcctttaatatcaaagcattgttagtgatggcaatttggcgccgctggggtttatgcataggcactgcataaagttgggcgaactattaacaatatagaaacaccgctggcgataaacatgcgctggcgcaaaatcgatgagagtaagggtagtatggcagccatttttctcgtataaagagaaaaataaaacgctgttttaactaaggggatgcgatgattattggcaatattgaacatctggaggtctggctgccgacggcgttacggcaggcgattgagcacgtcaatgcgcatgtcacgacaacgaccgcgccaggtaagtatgacattgacggcgacaggctgttttatatgatttctgaaaatatgacggagccgggcgaatcgcgcagcgcagagtatcacgctcgttatcttgatattcagattgtgctacaaggtcaggaagggatggcattcagtacccggcctgcgggaacgccgcacacggactggctggcggataaagacattgcatttttaccgacgagcgtcgacgagaaaaccgtcgtcctgaacgaaggcgactttgtggtgttttatcccggcgaagtgcataagcccctgtgcgcggtgggagaaccggcgcgggtacgtaaagcggttgtgaaaatgctgatggcgtaatattttgtgccggatggcggcgcctgcacgttgcgatcttgtaggccaaccgccatccggcatcatcacgacattatttagacagcgtcgctaccattactgctttgatggtatgcattcggttttccgcttcatcaaagacaatgctggccgcagactcaaaaacctcgtcggtcacttccatcccgccatgtaaaccgtactcttcggccatttttttgccgagcgtggtttcgtcatcatggaacgcaggcagacaatgcaggaacttaacctgcggattgccggttaaggccatcatctggctgttgacctgataatcacgcagcagggcaatacgctccgcccatttctctttgggttcgcccatagagacccaaacatcggtatagataaaatccgcgccttttacgcccgaggcgatatcttcggtcagggttatggcgccgccgttctttttcgccatggcgctgcactccgccactaacgcggcttgcggccagcaggcttttggcgcgaccagacggagatccaatcctgttaacgcggcggcttccagcatggagttacccatgttattacgcgcgtcgccggcatagaccaacgtcatctcgttaaaggctttacccggcagatgttcctgcatggtaagcagatccgccagtaattgcgttgggtgatactcatcggttaaaccgttccataccggcacaccggaatattcagccagcgtttcgacgatctcctggccatatcctcgatactgaataccgtcaaacatccggcccaggacgcgggcagtatctttgatggactctttatggccgatctggctcccgctggaacccaggtacgtcacgcgcgccccctgatcgtatgcggcaacttcgaaagagcatcgtgtccgggtcgagtctttttcgaagatgagcgcaatattcttacccaccagcttttgttcttctttaccgtttttcttatcggctttcagtttggcggcaagctgcaacagagcagtgagctcgctggcggtgaaatcaagtaactttaaaaaaggtttttggtaaaacgtagacatacttccctcacatggcttaggcctctcattgaattaaaattcactttatatggatgattattcatttgcaactctgtttgataaaacttttctcgataaggtggaggcaacgtcggcggtatgtgacaataagagtatcggcaggacatctatgaggaacgagctatggcaaacccggaattactggaagagcagcgtgaagaaacgcgcttaattattgaagagttacttgaggacggcagcgatccggatgcgctgtacactatcgagcatcacctttccgctgacgatttcgaaacgttggaaaaagccgcggtagaagcctttaaactcggctatgaagtgacggagccggaagagctggaagtggaagagggcgatacggttatttgttgcgacatcctcagcgagtgcgcgttgaacgccgaactcatcgacgctcaggttgagcaactgatgaacctggcggaaaaatatgatgttgaatacgacggctggggaacctatttcgaagaccctaatggcgaagagggtgatgacgacgattatgtcgatgaagatgacgacggcgtgcgtcactaaagctgcatagtatgacggtacggcagcgtctgctgtcgtatttttttaacaggttacgtatgaattacccgcaaatactctctccggtgcttaatttcctgcattgcccgacgccgcaggcgtggattgtccaggcccgcgatccgcaaaatcttcctcttctgcttaccgatcacctgatctgcgaactgaaggctgcgcaaaccgcgttgctgttggtgcgtaaatatgtcgccgataaatcgggcgccgacgcgctgctctcctggctgcaaccttacgaggcgttcgcgtttcgtcaggggccggagccggattttgttgccctgcataaacagattagcaaaagcgccatgccgcaaactgatgacccctggggacgtcagcttatcgaccgtatggtgttattgattaaagaggagttgcaccatttttggcaggtacgcgaggtcatgcaggccagaaacattccttatgtgaaaatcaccgccagccgctacgcgaaaggaatgttgaaagcggtacgcacgcacgaaccgctcaccttaattgataagctgatttgcggggcgtatatcgaagcccgctcctgcgaacgttttgccgctctggcgccctggctggatgaggatttacagacgttttatctctcgcttctgcgctccgaagcacggcattatcaggattacctggcgctggcgcagcagatttccgccgaggacatttctgcgcgcgtgcgctattttggcgaggtagaagctgaccttatcttgtcgccagaccgcgagtttcgttttcatagcggcgtgccagccgccggataaagggtaaaattaaagattagcgtttttatcttttacgctgtcgccacctgcgtggtcatccgcccgacatcaaactgctggcgagcagaaaaagtcattttcatgatattctgtcctgagtaaagcctgccctgcggcaggcaaaaagaactcactcagtgttatattcccgaaaggtgaccgtgaacaatgccatttttgcatcatcactacgggttcttgtgttgaaatacttactgtttcacgccttttgacgcttcagagcaggtcttgccaacaaaggtttgtttaattttgttgatggaggttgttttattacctcctgcatcgacatccgatttcatggtcatcgcaaattctgtatcgcttattttcgtcgtttctacaatagagtgcgatttgacatcaggattattacagacagtctcattgatcagtttggtatccgtactttctacaaatgttgtcgtgcaaccgcctgcactggtagaaaaacccttcaccatttttttagaatcttcagacattttaggggtataacacataagcgtcgctatgcccgaatttttttcatccattaatacttcttttgtatctggattgatggtgcgcatttctatattttccattttccattcgccgggctgtatatctaatgcatatacattagagatactaataaacatagcggggaaaacaattgctgataataggcgtttcatttataacttccttgaataataagtgattcccggataacaggatgtttccgggattatttatatcagcaaaaataatacctggcgaggataaataaacgcctggttttcagagatcctttaacatcctcacttcgcaatcgacatgtccggtgcagccgagcggttcgctaatatgttcaaatcctaaacgttcgtatagcgcaatcgcctcgcgtaaaaaagccgttgtttccagatagcagcgtttaaaaccctgttcacgggcatgatccagcgccatcagcgccagctttttcgccagcccctggccacgaatcaccggtaaaaaatacattttttgcagttcacaaatgtctggttcgctacaggataacggcgccacgccgccgccgcccaccacacaaccgttttgctctaccacccagtaggccgcgcccggttggctataaacctgatacagttcatccagattggggtcggcaacggtataacctttatcggcggtaagtccgtattccgctgaaacctgacggatgacacgggcaatagcggcattgtcggcggtagtgattcggcgcaccgtgagcgttggcgaggcgacattattcataatatggctcaatttttaaaatttatttatagattactttaataccaccgtcttgagttacgcgcaaggagatcctgaatcagacaaaataaaaggcggaaaaattaaacaaaaatagtatcgtagtcaaatcagtaacagtttactggtttttattattaattctaatagattgtaattcagggatatgattcatgaataacgttatcagtagtaaagataaccataatcacacgttggtgtttacaggcaagggcggaaagtattttgttatttgccttgtgaatttcttgttgacgtgtatcacgttgggaatctatgcgccgtgggcgatggtgaaatgtcgacgttatatttatactaacatgacgctaaacaatcagccttttgcttacaaagccacgggcggcgcattatttattagtgtgttgttagtttttattatttatattgttagcctctctcttattgaacacggtcatcccggtctcggttttacgctattcggcttattaattgcgattattccttttatggcggtgaaaggattacagtatcaggcgatgatgacttcgcttaatggcgtacattttggattccagtgttccatgcggcgcgcctggtggtacatgttcgctcttcctgtactcctgatggtggcgctttatattgttctttatattatctcactggtaaccatcgccgtcggcggtttagtgttcagtatcgtttttctcggtttgctggctattattgggataggggtcattaacggtattacctacagcaaatggatgaccttgtttggtaatggcgcaaactttggcattcatcgtttctcgattcaggttaatgttaaaacgtgcatcagagggtgcgtgttggcaatgttgacccttttcccttttgctgtcgtgattggttatctaatcgcgccggtgttcaccgacatgattcttttgagtatgatggggaatgcgcaggcaggaggggcgcttattctgcaatattatggccagataatggcatgttatttcctctattttctcgcgattattgtggtaaccagttacttatatgtggcgttacgcaacctgtttttaaacaatttgtcactggcgaacgattcgattcgttttcattcctctgtcactgcacacggtatgctgtggcggttactggtggtgtttgtgatttccggcgtgaccttagggctggcttatccgtggttgaaaatttggctggtgagctggctggcgcagaatacacaggtccagggcgatctggattcgcttgagttaaccaatgatgagaagccgctggaaaacagcccgctaatgtggatttctcgtggcattatgccttacttcccgtttatctgatgtaaaaaggccgacgtttacgtcggcccataattcatgttgtcggatggcggcgtgaatgccttatccggcctaccgatcgcgccatgtcaataagcgaacgtgtaggcctggtaagcgaagcgccatcaggctttcagattacagcgcgctaataaccgcctgctgctcaatcagtttcgctttggcttctgcgtaaccgtccagcttctcacgctctttggcaatcaccgcttccggcgcacgggcgacgaaaccttcgttggacagtttgccttcgatacgggcaatctcgccttcgattttcgccacttctttcgccagacgcgccagctcatcgtctttgttgatgaggcctgccatcgggatcagcagttcggcgccgtcgatgattttggtcacggaaaccggacctttgtcatcggctggcagcacggtgatgctttccagacgcgccagggtttgcaggaagctacggttgtcgttaacacgacgaacggcttcttcactacagccgcgcagcagcagttccagcggtttgcccggggcgatgttcatttccgcacgaatgttacgtaccgcgacgatcgcctgcttcagccactcggtatcggccagcgcggcttcatccacctgtgcggcgttatattccgggaacggctgcagcataatggtatcggcggtaatgccacagataaccttcacgcgctgccagatggtttcggtgatgaacggaatgatcggatgcgccaggcgcagcagaccttccagtacggtgaccagcgtatggcgggtgccacgcagttcagactcggaacccccggtcattaccggcttggtcagctccagataccagtcgcagaactggttccaggtgaactcgtacaggatgcccgcggcgatatcgaagcggaagctgtccagcgcgtcgcggtacgctttaacggtctggttgaattccgccaggatccaacggtcagccagcgacagcgtcatttcgccgccgttgaagccgcaatcctgctcttcggtgttcatcagcacaaagcggctggcgttccacagcttgttacagaagttacggtaaccttccagacgcttcatatcccagttgatgtcgcggccggtcgaggccagcgccgccagggtaaagcgcagggcgtcggtgccgtgcggctcaatgccgttcgggaactgcttctcggtacgcttgcgaattttctccgccatctgcggctgcatcatgttgccggtgcgtttttccagcagttccggcagggagatgccgtccaccatatccagcgggtcgataacgttacccttggatttggacatcttctggccttcgtcgtcgcgaatcagaccggtcatgtagacggtatggaacggcacctgcggcttgccgttttcatctttgatgaagtgcatggtcatcatgatcatgcgggcaatccagaagaagatgatatcgaagccggacaccatcacgctggtggggtggaactgacgcagggcgtcggtgttttccggccagccgagggtggagaaagtccacagcgcggaggagaaccaggtatcgagaacgtcttcgtcctgacgaagcgcaacgtcggcgccgaggttattttcctgacgcacttcgtcttcggtacggccaacgtagacgttgccgtcgttgtcataccatgccgggatacggtgaccccaccacagctgacgagagatacaccagtcctgaatatcgcgcatccaggagaagtacatgttttcgtactgcttcggcacgaactgaatgtcgccgttctcaaccgcttccaccgccggtttcgccagcacgtcagcacggacgtaccactggtcggtcagcatcggttcgataaccacgccgccacggtcgccgtaagggacagtcagatcgtgcggtttaatttcttccagcaggcccagcgcgtcaacggcagcaacgactgctttacgggcagcaaagcgttccagcttctggaactcagccggaatctcgctggaataaacgtcagactcttcacctttggtatcgaacacttccgcgctttcgcggatgtcgccgtcaaaggtcaggatgttgatcatcggcagggcatgacgtttcccgacctcatagtcgttaaagtcgtgcgccggggtgatcttcacgcagccggtgcctttttccatatcggcgtgttcgtcgccaacaatcggaatgcggcggttaaccagcggcagaataacgaatttaccgataagactctggtagcgcggatcttccgggttcacggccacgccggtatcgccgagaatagtttccgggcgggtggtggcgacaaccagataatctttaccgtctgcggttttcgcgccgtcggccagcggatagcggatgtgccacatcgagcctttggactcgcggttttccacttccaggtcagagatggcggtgcgcagtttcgggtcccagttcaccaggcgtttgccacggtaaatcaggtcttctttgtacaggcgaacaaagacttctttcacggcattggaaaggccttcgtccatggtgaagcgctcgcgctcccagtcaacggagttgccgagacggcgcatttggcgggtaatggtgccgccggattccgctttccactgccagattttgtcgataaacgcatcgcggccgtagtcgtgacgggttttaccttcttcagcggcaatcttgcgctcaaccaccatctgggtggcgatcccggcgtggtcggtgccgacctgccacagggtgtttttaccctgcatacgctggtaacggatcatggtatccatgatggtttgctggaaagcatgtcccatatgcaaactgccggtgacgttcggcggcgggatcatgatgcagaaggactctttgctttcgtcgccgttaggcttgaaatagccctgcttttcccagtgctcgtaaagcggctgttcgatatcttgggggttatatgtcttttccattatttccaggttgccgtattcaggttaaaaccagccacgcggtaggctttgtagcgttcgcgcgccagttgtttcaaagtttcttcgtaagggacgaagtctaccacttctgtgaaagcggtggcaaaatctgcaaagcttgtacgcaggctgattaaaatatcgcgcgggctgctgttgcgtttttgcggccaggcgatttcaaccggcgcgccgccgcgtgggccttcgcctgccagattgtgcgggacaaaactttccgccggtcttgcccacagcgcttcatccagccgaatggcctgcttctcatcttcgcaggcgatcagcacgcgcttgcccgcgcgccaacgttctgcggcaatttcacacaccagttgttcaacggcgcttaaaccgttgacggtggtgtcattatccagaagatagaacgtcgcatttttcatatatggggcttcttgtggtggatttaaatgcgttgtcatgatgcctcccgtaggccggataagcgcagcgccatccggcaaaacgcctgatggcggcgctaatgcgccttatcaggcctacggggtaatctcaaacttactcttcgccgttaaagcccgcacgattgagcaggaactgcgacagcagcgctaccggacgacccgtcgcgcctttcgctttgccggaacgccaggcggtaccggcgatatccaggtgcgcccagttgtacttacgggtaaagcgcgacaggaagcagcccgcggtgatagcgccgccaggacgaccaccaatgttcgccatatccgcaaagttggactccagttgttcctggaactcatcgcccagcggcagacgccacgcgcggtcgcccgcttgctcggacgcgccgatcagttcatgcgccagcgggttatggttcgacatcagaccggtaatgtgatggcccagcgcaatcacgcaggcgccggttagcgtcgcgacgtcaatgaccgcttccggttcgaagcgctcaacgtaggtcagcacgtcgcacaaaaccagacggccttcggcatcggtattcagcacttcaaccgtctgaccggacatggtggtcagcacgtcgcccggacgatacgcgcgtccgcccggcatgttttcacagcccgccagtacgccgataacgttaatcggaagctgaagctcggcgaccatacgcatcacgccgtaaaccgccgccgcgccgcacatgtcgtacttcatctcgtccatcccttcagatggcttgatggagatgccgccggagtcgaaggtcaggcccttacccaccagcacgatcgggcgcgcgtcttcggacggattgcccttgtactcaatcaccgacatcagcgattcattctgcgaaccgtggccgaccgccagataagcgttcatacccagttcgcgcatttgctgttcgccgatcacgcgggtaatgacatttttgctgtagctgtcggccaactggcgcgcctgtgacgccaggtaggcggcgttacagatattgggcggcatgttgccgagatctttcgcagccttaatcccggcggcgatggccagaccgtgctgaatggcgcgttcgccgctggtgagctcacggcgggtcggcacattaaagaccatcttacgtagcgggcggcgcggctcgctcttgttggtcttgagttgatcaaagctataaagcgtctctttggccgtttcgacggcctgacgcactttccagtagttgttgcggcctttgacgtgcagttcggtcaggaaacagacggcttccatcgaaccggtatcattcagagtatttatcgttttctgaataacctgcttatactgacgttcatcaagctcgcgctctttgccgcaaccaatgaggaggattcgctcggaaagaacgttaggaacatggtgcagcaacagagtctgccccggttttccttccagttcgccgcgacgcagcaatgcgctgatgtatccgtcgctaattttgtcgagctgttctgcaatcggagaaaggcgacgcggttcaaagacgcccacgacaatgcaggcactccgctgtttctccgggctaccgctttttacactgaactccatgcactatgctcctgaatcttaaagacaacagtggtggctacagctatactcgtcgtctttcaagttgcagatgcgttggctgcgcctgctcacccctgtcgcttacctgatgtaagctccggggcttcacagtcttgccgcctgcctgcaactcgaaatccattagagtatagaaattgaaagctttcgtaactcatatccgctgttgcggtgacttcgtgttaatcttaacgttattacggcattggcacgtcagaacaagttctgagaggtgaatccgctgagtataatgatcttagcgatgatttcgacgactcaagagaataaatgacgtttaagccatgaaacaagctaaattccagcaaaaaaatgggtttttacgggcgtatttaaagtgataatcataagatatctggtgcgggagacgctcaaaagccagctggcgatactcttcatcttacttttgatcttcttttgtcaaaagttagtgaggattctcggcgcggcggttgacggcgatattcccgcaaatctggtgctctcgcttctggggctgggcgtaccggaaatggcgcagctcatcctgcctttaagcctgttcctggggctgctgatgacgctgggcaaactgtataccgaaagtgaaattacggtcatgcacgcctgtgggttgagcaaagccgtgctggtaaaggccgccatggtactggcgttatttaccggtatccttgcggcggttaacgtgatgtgggccggcccctggtcgtcaaaacaccaggatgaagtactggcggaggcgaaagcgaaccccggtatggcggcgttggcgcagggacaattccagcaggcgaccaacggcaactcggtgctgttcatcgaaagcgttgacggcagcgacttccacgatgttttcctggcgcaaattcgccctaagggcaatgctcgtccttctgtagtcgtggccgattccggacaccttactcagttgcgcgatggttcccaggttgtcaccttaaacaaagggacgcgttttgaagggacggcgttgctacgcgattttcgcatcaccgacttccagaactatcaggcaattattggccatcaggccgtggcgctggacccgaacgatactgaccagatggacatgcgcacgctgtggaataccgacaacgatcgcgctcgcgccgagctgcactggcgtatcacgttagtctttaccgtatttatgatggcgctgatggtcgtgccgctcagcgtggtgaatccacgtcaggggcgtgtcttgtctatgttgcccgccatgctgctttatctgctgttcttcctgatccagacctccattaaatcgaatggcggtaaaggcaaactggacccggttatctggatgtgggcggtcaacctgatctatctggcgttggcgattggtttaaacctgtgggatacggtgccggtccgccgcctgcgtgcccgttttctgcgtaaaggagcggtataatgcagccatttggtgtacttgaccgctatatcggtaaaaccatttttaccaccatcatgatgacgttgttcatgctggtgtcgctctccgggatcatcaagtttgtcgatcagctgaaaaaagcggggcagggtaactacgacgcgctgggcgcgggtatgtacaccctgctcagcgtacctaaggatatccagatcttctttcctatggcggcgctgcttggcgcgctgctgggactggggatgctggcgcagcgtagcgaactggtggtgatgcaggcatcgggtttcacccgtatgcaggtggcgctgtcggtgatgaaaacggctatccccctggtgctgttaaccatggcgatcggcgaatgggtcgccccgcagggcgagcagatggcgcgtaactatcgtgcgcaggcgatgtatggcggttcgctgctttccacccagcaaggtctgtgggcgaaagacgggaataactttgtctatattgaacgggtgaagggcgacgaggagctggccggcattagtatttacgctttcaacgatcagcgtcgtttgcagtcagtgcgttacgccgcttcggcaaaattcgacccggagcataaggtctggcgtttgtcgcaggtggatgagtccgatctgcaaaacccgaaacagatcaccggttcgcagacggtgagcggcacctggaaaacgaatctgacgccggataagttaggcgtggtggcgctggacccggatgcgctttccatcagcggtctgcataactacgttaaatatctgaagtcgagcggacaggacgccggacgttatcagctcaatatgtggagtaaaatcttccagccgctctccgtggcggtgatgatgctgatggcgctgtcgtttatctttggaccgctgcgtagtgtgccgatgggcgtgcgcgtggtgacggggattagcttcggcttcgtcttttacgttctcgaccagatttttggcccgctgacgctggtatacggcattccgccgattgtcggcgcgctgctgccgagcgcgtctttcttcctgattagcctctggctaatgctgcgtaagtcgtaatcacagtaatcgtaggcctgatggcgctgcgcttatcaggcctaccatgacccgtaggcctgataagtcctttccgccgccatccggcagaccgcctggtattcctcgaatgatgtagtgcgtaacctgacgcgtggcgcttttggctacgcgttaagctcaggcaagctgcgggaaaaagtagaacaaaaaatttataacgtgctgccgtgataaatctgataacccaaatcaatcgtattatggttgagatcgttatttttaattttgttgagcaacatctgcgcggctctgcgcccgatctcaaaacgaggggtaattacgctggcgaggctcggtatcatttgcctgcccatctccagaccgtggaagccggcgatggagatctgctccggtacggccagttgacgctcgcggcaccacagtagagcgcccattgcgatatcgtcatttgtacaaaagacgccatccacgtccgggtgcgcagtaagcgcatcacgcattagctgtatccccagatggatagaggagatagcgcgtggattgatgcgcaacggcgccagcccccggcgcgtcatcgcatcgcagtagccgtgataacgctgctcatctcggatatcgtcttttgaacccagatagaggatttttcgccgctggcgtttatccagcatggtgctgaccatatcaaaggcggcctgacggttatcaaaccccacctccatatctaagcgatcgccctggatgtccatgagttctacaatcggaagggtagctgagcgcaggaatttgacggttctgagggtatgatatttttctgaaagaataatgccgtcgatattgtaagacagtaaattgataacggactcttcttccgaatcgcgattgtaattgtaattcgcaatgagagtttggtagttatgacccgacgttacggattcaatcccggcaagaatgtcggcaaacaactggttctggaaagaggggatcagcacgcccagagtgtaactttgcgcgtttaacagcatagctggcgcgcgatttggtatgtagttaatttcctccatgatctgcgcaatacgctcgccggtttccctggcgacttttttcggcgagcggatgtaacggctcaccgtcatttttgtcacgccagcaagcgtagcgatatcctgcaaagaaattctgtgattcctcatgttttctccagtaccggaggcgggaacgtcgcccccatggttaattgggctgcggatgatgaattaatgcagaaccgcattcagcgccagtacgcccagcaaccccatgacagaaatcaatgtttccataacggtccaggtgcgtagggtttccccgacgctaagattaaaataccctttaaacagccaaaaaccgggatcgttaacatgtgatgcaataacgcttcccgcgcctgtcgccagtaccattaacgccggatcggcgtgggttacgttaataatcggcaatacgacgcccgctgtggttatcgcagccacggtcgcggaacctagcgcaatacgcagcacggcggctaccgtccagcacattaataacggagatagcgaggtgccggtcattaattgcgagatatattgacccacgccgctatccaccagcacttgcttaaacgcgccgccgcccgcgatgataaaaacaatcatcgcaatagcgccaatggactcgccgacgatatccatcacctgctcaaccgtacgtccgttgcgtcggcccagcgtaaaaatggcgatgataatggcaataaacaacgccactgctggattaccgataaattcgaagaaaacccgcacggcattcgtttttggcagcgtgatttcacataccgctgcgatggccatcagaatgaccgggatcacggcggcaaaaatactgttccagaatgacggcatctcctcttcactgaataggtgaggattaaataatccttcaggcggcgctttctcaaagcgcgccagcaattttgaaaacagagggccggcaacaatcacggtcggtatggtaatgattaacccatacagcagggtcgtaccgagatttgcctcaaaaattgtcgcaatagcagtagggccgggatgcggcggcaggaagcagtgcgtaacggataaggcggcgaccattggaaccccgacatacagcaagggcagtcccgatgaggccacaatcgtaaaaacgagcggcaacagcagtacgaatccgacttcaaaaaacattgccaggccgacgataagcccggtgatcaccagcgcccattgcacgcgttttttgccgaacgtattaatgagcgtcgtcgcaatgcgctgcgcggcgccggtatcggaaattaatcttcccagcatcgcgccaaaaccgaggatcatggcgagtccgcccagagtaccgccaattccgttttgtatggagtgcaggacgtcttgcgcgcccatcccttcggcaaatcccaccacggcggcaaccagaacaagggcgataaagccgttaactttaaagccaatcattaaaaccaacagcagcgcaacgcctgccgcaataattattaatggcatattcgtctctcttattagcgccaaaatagcagcgcttacgcgctgcgtcgtatttccctggtcagacggcaaccagcataccgccatcgacaaacagcagatgtccgttaacaaagtcggaggcttttgacgagagaaacaccgctgcgccaataagctcctggggatcgccccagcgtgcggcaggcgtacgtttgcatagccaggaggtgaaggcttcatcttcaaccagcgctttggtcatctccgttttgaagtaccccggcgcaataccgttgacctggatattatgacgcgccagctccacgcacatgccgcgagtcagcatcttcacggcacccttcgacgcggcgtatggcgtaatcgtgtcgcggcccagctcgctttgcatcgaacagatgttgatcacttttcctgcctgccgcgccaccatacggcgcgtaacggcctgagagacgagaaaaaccgcggtctgatttacggcgatgacgtcattccactcctgttcgggaaactcagtaaacggatgacggcgctggataccggcgttatttatcaggacgtcaatgacgccgatatctttttcgatatgttcaaccgcagcttcaatatcctgtttatgggtgacattaaaaggagcggcaatagcctttatcccttcctgctgaagtttcgtcacggctgtttcggcgcgctccggggtgatatcgttaacaataatgcgcgcgccatagcgaccaagaccggtcgccagcaaataaccaattccctgagcggctccggtgataaggatatttttacctgccagtgaaaaaagatcgttcatgatagtgtcccttattttactttctcagaaaacgagctgaacttttgccgcctgtgttttgtctccggcaaagatcagcgccgcttccaggtcggtaaatggatattccgcgctcagtaacggcagcggattgataacgcggttggcaagccaggaaaccgcagtattaaattcggtagtaaagcggaaagagcctttcagggagatctctttgcttattaccatcatcatcgggaagttgggaactgcgccgcccatgccaacctgcaccatcacgcctttggcccgtgtgacttccagacacgttgagatagaggaaggatgcccagagacttcaaaactgatatcgaaataccctttttctgctttccagtcatcgagagaatcatgctgtgggttcaccagcgtatccgcgcccatctgccgggccagcgagagagaacgggtactgatatcggcacataccacttccgccgcgcccagcgtttttaccgcgctaacaatcaggcagccgatagggccaacgccggagataaagatgcgtttgccctgcagatcgcccgcctcatgagctgcatgaatggcaaccgccagcggctcggcaaaggccatggctttttcgtccgcctgttccggccagggaatgcactgagcggtatcgacagctttaaatcgggtaaaaccgccatcgacatgcggaaaatacatggcgctgccaaagaaacgcatttcagtacagtggttttcttcatgctgcagacagtatttgcaatgaccgcaaggctccgatggattaattgctaccggttgtccttcacgtaataaatctgagtcgctatgaacgattttgccaatcacttcatgacctaaaatcattggcgcttttactgtaaaattgccgactttgccttcctgataataatgtaagtcagacccacaaatgccgccacgggtaatttgtacgagagttcctttattattccattcaatattttgttccgtaacggcaacagcacgcttacccgcaacaacgcaggattgagtttttacttccataaattcctcactggtcaggtagttaccctgaacgcatttaagcggttttatttgtcactatttgtgacttatgtcacgctggaaaattgttacactacaatgttacgcataacgtgatgtgccttagagttcttctctatggaaattaaaaaacgtgaaattgtcgaacgtagaggcgtaatattgtgttgtggaatatgactcagaggtatttaaatggccggggaaagctatattttaatgggtgtttcaggtagtggtaagtctttaataggcagcaaaattgcaacattattttctgcgaagtttattgacggcgatgatctccatccggcgaaaaacattgataaaatgtctcagggaataccgttaactgatgaagaccgcttaccctggctggaacgattaaatgacgcttcatacagtctttataaaaaaaatgagacgggatttattgtttgctcgtcattaaaaaaacagtaccgcgatattttacgtaagagtagccctaacgtacatttcctgtggctggatggcgattacgctactattctgcagcgaatgcagcgtcgtgccgggcattttatgccgccagacctgctgcaaagtcagtttgatgcgctggagcgaccctgtgccgatgaacatgatattgcgcgtatcgatgttaatcatgacatcgagcacgtgacggagcagtgccgactggctgtacaggcttttcgtcaggcactcagcgcttcctgatcattgtcaaagcgctgagtcaggcggtcagaagtcagcttttagcactacacgatagcgggctttgccgtcgcgaacgtgctggatagcctcgttgatttgtgacattgcgaacagttccgtggtgggcgcgactttactgcgtccggcgaatttcatcagtttgcgaagttcatatggcgttccggttgccgagcctgagatactgcgatcgccggcaattaatgtaaacgccggtacgggcagcggcttcaataccgccccaacggtatggaagttgccgccataggtcagcgcttcgaagtagggttgccagtcgagatcgacgttaaccgtgttaataatgagatcgaactgacccgccagtgcttttaacgcttccggatcgcggctgttcaccacgttattggcccccatcgccagcacttcctgctccttcgatggatttgagctgaacgcggtgacttcgcagcccatcgcgtgtaacagctttatggcgatatgccccagcccgccaataccgatgacgccaacgcggctggtagcagtaatatggtgcatcaatagcggtttaaagaccgtaatgccgccacataacagcgggcctgcggacgccatatctatattctccggaagaggaattacccactgccagcctgcgcgaagcttctcggcaaaaccgccacgattgaggatagtgggcactgcgccttcctggcagttaatttgattgccgctgatacaggcatcgcagtgtccgcagctgcgcgccgtccagccgattccaacgcgctggccgacttttagccccttatcctgtgccgcgctgccgagtgcggccacccgaccgatgacctcatgtccggcaaccagagggtattgagagaacccccattcattgtcgatcattgacagatcggaatggcagatcccgcagtagtcgacccgtacctcgacatcttccggttggagttctcccgcgtcatattcatagagttcgagctcgccgcccgcctctttggcggcatagctttttattatcgtcattgtgtttcccttaatgtggtgttgaactgaaaagtgtagagcatggaggcaagggacgcccggcgttaatctgctggagaaggcgggaagtagcctgattattctatttaatactcaacgctgctgaaattttcagcacttagcgatacaggtgtatgctcgtgcttgcatggtggcgtatgacaggtataatccacaacgttttccgcatacctcttcagtgccgaagtggcgaaatcggtagacgcagttgattcaaaatcaaccgtagaaatacgtgccggttcgagtccggccttcggcaccaagtgatgcaataattagctgcctaatggtggctttttttgtgtccatttccgtccaaattcgtccatatccatctgtaattcaaagataatttatttttctgtaatagaaatatttattttgtggtctttccgtgttggtcgtttttcatccattaacatccacgcgatctgggggcaaaaaggggcaaacccggttcgatagaggagtgccccccaaatggcgcttacagatctcgcaatccggcatgccaggctgcctggcaaggcatacaggctctttgactgccacggtttttacattcaggtgaaccccagcggatccaagctgtggtatctgaaatttcgctttggaaacaaaaagaaccgtatggcattaggcccttatccgctcatttctcttgcactggcaagggagaagcaagcggatataagaaggcttattttagaaggtattaatccggcggaaaaacgcagagaggacaagcggggtggcgagcctctttaatacgttcgagtccgtagtgcgcaaatgcgtctccagcaacgtgaactggtcgacggaacattcgacagcgttattttctgagcttacaggttttccaatattgcactgaacgctatccagtcgggttcacgggcttctggagcgagctgcgcagccgataatcctctactgcttcagttataacgctattatgtgacatgcagcatgatatggtcgttttctgaactccgtataacctgagtatttgtattgaagcgtgaacaaaacattgcagccagcctttcaacgtggacaatagttattcatacggtgattttatattcgataaatcaatgggtttcattgaaacataggactggtaatggatgacaatgctttagggtttgcctcatactggcgcaattcgctggcagatgctgagtcaggaaagggcagttttgaacgcaaagacgccaaaaatttcacccactggcatgggatagcggcgggacgtcttgacgaaacgatcgttggtaaattttttgagggagaaaaagacgacgtcgaaacagtcgatgtcatcttgcggccaaaggtttatttccggttactgcagcgtggaaaggaccattccgctggtgcgcctgatattgttaccccgatagtgacgccagccctattgagccgtgaaggttttttatatccgacgccagcgacctccattcccagagacctgcttgaacctttgccaaaaggggcattttcaattggtgagattgagcagtacgacaaatacaaaacgacacatacgtcattctctatcaactttgatgaccgcgttgataagaccgccgaaacagatgaagaacgagaagcacgatatgcagcctggcagcaggattggcgtcaatatctggatgattcagaaaggctgctgaagaacgttgtcggcgactggattaaaaatcctgagcaatatgaactcgctgagcacggttatattgttaaaacggcgcaatctggcggcgccagtttccatatcctttcactttatgatcacctgcttgtttgcaaaaaggatgtgccgctcttcaatcgtttcgcctcgcgagaggttcatgctgcagagtcattacttcctccggaagcaaaattcagcgacaggattggacactccggggataagtttccgctggcaaaggctcagcgcgatgccttaagccattttctggatgcgaggcatggcgatatccttgccgttaatggtcccccgggaaccggaaaaaccacgctggtgctttctatcatcgccacgcagtgggcccgagcggctctcgaaaaagcggaacctccggttattatcgcgacttcaacgaataaccaagctgtaacgaacattatcgaggcgttcgggaaagatttttcccaaggcactggtgcaatggccggacgatggttgccggagctgaaaagcttcggcgcttattttccctcaagcactcgtaaagccgaggccgccaaaaaatatcaaactgaagatttcttcaaccaggttgagtcaaaagagtatgtagaggatgcactgctgttttatctggagaaagctaaggcagcctttcctgaaaaagagtgttcatcccctgaaaaggttattgaactcctgcatggtcagttggcagcaaaatccgagcaactggtaagactgaacgcaacatggcaaacgttaagccaggttcgggcaacgcgagagcttattgataacgacattgagcaatatctcgataatttaaataaattactctccgggcaagaacaaaaagttactcaactaaaaagtgctaaagcggaatggaaaaaatatcgggccagtgaatcactgatctatccattattttcatggctaccagtggttcgcagtaagcggcagtaccaaatacaactgtttctcgaagataaattaggtgcgctgattgcgggaaatcaatggtcggatcctgaaaccatcgaacgtaatatcgataggttgcttaattccgccgagcgcgagcaaacaacctaccggcagcagattgactccgcgcatgaaatcgttcttaaagaacagcaggcggctcaggaatggcagaggctggcacttgatttagggcatgagggcgacgaggaactgagcttctcacaggcagatgagctggctgatacgcagattcgcttccctgcattcttactgacgacccactactgggaaggtcgttggttgatggatatggccggcattgatgatctgcagaaagaaaagggcaagaaaggtgctaaaggggtaacagctcgctggcaacgccgaatgaaacttaccccatgcgtggtcatgacctgctatatgctgcccggcaatatgcagataagtgaacataaagggcagcgtaaattcgagaaaagctatttatatgacttcgccgatttactcattgtcgatgaagctgggcaggtgcttcctgaagtggctgctgcctcgtttgccttagctaaaaaggcattagtgattggtgatacggaacagatcccgccaatatggagtattactcctgctattgatataggtaacatgctggcggaaaaaattctgtcaggcagtacgcaagaggagattactgagaaatatacggcaatcgcagagcttggtaaaagcgccgcatctggcagcgtcatgaaaatagcgcagtgtgcctcacgctatcaatatgatcccgaactggctcgtggaatgtacttatatgaacaccgccggtgcttcgataatattattggatactgcaatacgctctgctatcacggtaagttgttgcctaaaagagggtgtgaagagagcaatttaatgccagcaatgggttatctccatattgatggtaaaggagagctggcaagtagcggaagtcgatataatttgctggaggctgaaacgatagcggcctggctgacagataaccagcaaagtattgaagcgcattatggtaaatcgcttcatgaagttgtcggtatcgtgacgccttttagtgcgcaggtaccgaccatcaaacaggcgctggataaacaaggcatcagcgcaggcaccaatgaaacgtcgctcacggtgggcacagtccattctcttcagggcgctgaaagagcgattgttatattctcgccagtctattcaaagcatgaagacggcgcgtttattgatagcgataacagcatgctgaatgttgctgtctcccgagctaaggacagtttcctggtcttcggcgatatggacctgtttgagattcagccagcctcatctccgcggggattactggcaaaatatctctttgagtcagagaagaatgcgctcacttttgattataaagagcgtaaggatttaaaaactgccgagaccaaaatctacacactccatggtgtggagcagcatgataatttcctgaatcagacgtttgaaaataccgataaacacatcacgatagtttctccatggctaacctggcaaaaactggagcaaaccggttttcttgattccatgattacggcgtgttcacgtggtattaacgtcacggtagtcactgacagaagctacaacactgaacataatgattttgagaagcgaaaagagaagcagcagaaccttaaagcggcgctggagaaactgaacgcccttggtattgcgacaaaactggtcaatcgtgttcatagcaaaattgttattggtgatgatggtttgctgtgcgtgggatcgttcaactggtttagcgcgacacgtgaagcgcgatatgaacgatacgatacatcgatggtttattgcggtgataacctgaagggtgagattgaggctatttataatagtcttgataggcgtcaggtttagggcaggagtgtgattagccatcttatcagtgtttccccagggtaagatggctgtgaggcattttcagaaggaatcattgtggcgactaaaatgtggatgatccgcggtgatggcggaaaattgtacgatgacttcagagacaagcaggttgttgctatcggctggtcgcagctcgctccctatgtgaaaccgggatgctcaagagagcagttgtttacccggtatcaggagcttgagccacagactaagtcaggcacagttcgttccggtgcttcgcaggtctggcgctttgtgaacgagatgcagaaaggtgactgggctatcacttattcaccttctaatcggacttatttgatagggaaaatcgcctcagattttgagtttcatgccgagtggcttgaagatggcatgggcatcgcccgtaaagtgaagtggaacgcggaagagattaagcgtgatagtctgagtgatgcaaccagaaacacccttggctcaacgctgacggtttttcaggtgcctgattttgccgtgaatgaattagtgcagggcaaaaagcctgtctcagatgtcgtgccggaagtacctgtttcaggtgaagaggatgaggttgtttctaatcctctgcgtgacatggaaatgattgcctttgaaggcatcaaagatcgtatcaaccgtctcgactgggatgagatgcaaaatctggtcgcaggcgtgttacgcagcatgggatataaaacccaggtatcgcctgcgggtgctgaccgcgaaaaagacatcattgcttcgcctgacggttttggcttcgaaaatccgcgcatcattgttgaggtgaagcaccgacgggaacagatgagcagccagcaaatccgtagctttatcggtggccgtcataaagacgatcgcgggttgtatgtcagcacaggcggattcagcaaggatgcgcgctatgaggccgatcgctctacaatcccgttgacgctatggacgctggacgatttagtacgtgcgttagtggaaaactatgagcaggtggatattgaaactaagctgttggttccacttaagaaaacgtacttgcctgcatgaagggaaaccaggggttacagtaatcgtagtgatatttagactaatatgaattttaactaaaataacgacgatattgattttatcgaggagtttgacccactcctcgatatatttagtttactcccaacgccttataaaccgcatctacaggttcagagtaaaaactgacctggaatttggtaaacaactcggctggcacagtcggaatatctaccgcggaagacatcggcaaaaggacctttttcgcgccactatcgaaagcaagttgtaagctagccgccagatcctgaaccgggttgatcacaccaccgagcgtcatgctacctaacacgaccatttgttcctgaacgggtttcgccagtaaaacggaacacagcgcgatcagcgcggcaagactggtcgcggtacttggtccagtattgtgcaattcgactacgtgcaggtggtactcatgttcagaaaatttcgctgttgcgctaacgcggctgaggttgcctttgaaatagtcaaatccaacccggatggcttccttagccgaggtgcttgatcccagaccagaaacgctatgcttaccattgcctgcggtcatctgagtttcgaagcgatacagacccgtcatgccactttccgcttgcgtaaccaaatgcactacaccaggtttgggcatgccagcaggaattaattcgctgccaccctgttccggcacgctgacgaagaattcttccagcgtctcgttatcaatgtagctgaaatttacatcgaagaactccagaccgcccagctttttaagctgttctttgacgcgacggcgagcttccatggcgtaggtcaggcaaacacggacatcttctttgctgtaagaaccattggggtgaagaagtttcagtagaccagaaaccgtgcgccttaccgcgataacgtcgcgctggttgaggttattacccagcttatagaacttatcaatcgcgtcggagaagctgcgcttacgcatttcccgcatgtattcggcgagataatctgtgataaggccgtagcgattggtaaagaattccgggcgcattttcggaatttcccagccggggatataggcatggaagcggtcgaaaaacgccgtatcgatcatcgcggcagggaagggggctaacagatggctggttttgactagcgtctcaacgctttggttaatgttgccgacgaacaccatcgatgctttgccttcaatcgaatctcttccgcgggaaaacgagccagacgccatgtaatccttcatgatttgcacgccgtctttgtctttgaaagtgatccccgccacttcatcaaacgcgacgacatcccacatgccaaccaggccaatctggcggctggccatgttgtaaaacaggttggctaccgtggtttgcccgccggaaactaacagtgagtttggcgaacattctttatagacgtggcttttaccggtgccgcgtggacccagttcgcagacgttatagttgttttccacgaaagggatcatgcgggtgatcaggtgccacttggttcgctgctcaatgttagcgggttccatacccacggaacgtagcaggacatcaatccactggtcgcggttgaagtgcgtacgtgcggtaaatacctcttccatgtccatattgggcatctggataggtttaagcgtcatcagagagaagggcgacgttttttgtccttcctcaaagaagtagttcacggtgatcatgcaccagatgccgccggtcaacagcttctcgttgtccttgaccatctgcggcggaaccagtgcatctttaatgccgaggttggagagctgggcttcgtaaacgtctttcttctgattgagctttaccgatactttatcaatgatcttgtaggatcctcgctcacgaatgagcgatttcaccttctctgcttcatcagggcggacgtagttatcagccagaatacgcttaacgttctgcaacccttgctcgacgatctggtcatcgtcggaagcgcagtacataccgagcagatactccagcacatagaccgggacatttgccccttctttgagctgtttagtcaggtccttacgtactacccgaccacgaaaatgctgattcagcaaggcgtccagatcgtaaccttctgcgacgagttccccttcggatacagctggaacgggtaagtcatgatgggtttgcatagcgcctcacttaaaagaaatcatcctgaaatgccagatcgataatcacagggtacttctggtaacccgtttccgtttgtgcatcttccagtatcagccagtattcattacggcgattgaaattcgcgccaatcagcttcagcgtcacgtcacgcacgcgtttttccattgtgttgttatcgctgtcaaagcagattcgctctttaccggataccacattattggcgttatcgacgatgaagatgttcagagtacgtggttcgtataactcacctaccggatgggtttgcagcaggctgactttatcaatgttattgacgagtttgatcagcggatgatgcttgacgatgtctaccggacgacgctgaggttgcttctcggcagccgttttctgcagtgctttcacctgcaatacgggaacgcagacttcctgtagcatggcgccaccatggacaaaccgcgcgccgcccgagaaatggaaacgctggatccctttcgggatcaggaactcgctgttatcgctgacgcctgcggtatccgccacttttcctttccagcaaaaatcatcggcaggaagctgatgaccgataataaagcgtttgtggtttttaatcgtattgtctggcttgatctgcagcgtggttttatcctggccggaaaggggctgctgctggaacaggaaaccgtggtccgccgtgacgataatccgtgtaccgtggagacggtttattacacgagtcactaaatccttcagttcaaccaccgcgttacggcacgcttcgaaggtcttctcctccgtcgatgcgctgtcacccatggcatcaatggtgttatgccagatataaacgacttcgtaatcgcgaataagatctcgtccttgctgatttttccatttcagcagatcgtccgattttactgccatccctttatatttcttcagaatggtatcgcggttaggcgtacctgaggtggataacccgtccgcataaacgatgtcaccactacccggttggtagcatatctcgtcatggggcagcaatgccgccattcccagctgggtatagctgggtaacacgcccaactgggaacgcagttcggcagtaaagcgtttctcggtattgatctggttgcccagctcttctgccacttcataacgcagcgcgtcggagataatcacgaatacgcgcttgatttgtggattgttaaactgcggcttaaccacctcattgtagaagttctgctgccgtggtacgcccgcaatacgccactcctgcatacggttttcggtttccagaaccttattccagctccggcttaattctgccaggtaccagttggaatacagcgcttcgatatagtcatccaggcttttcaggatcattgcgcctttgctgtgaaccaacagcgcgtattcgttaaacaggcggtaggcctggtcaaagcggaacagctcctcgcagtacgctttccagaacgttgcgctgtcctgatagtggaaaccatcaatatgacgattacgcagattcagcaaccgttcggcctgacgcagtgcatcgtaaatagcgcagtattcctgacgcgtctggcaccagtatttgctctgacgttcagacagaagcttcttaaaggcttcacggtctagcgtggtgctctcttccagaagctgcgtcaccagcgcatgaatgatggtctgttcaatgctcagcgtggtttcgcactcgtgcagatcatacggcgagctgagacggtactggtcttctggtcgcagcgcatcctgcatctgctgtgcgcaataatcataggcttctttgtagcgacggtcggcgcgccaggtgaccataaaggccagcgcggaggctctgcctgacggcgtggccagcacgtttttttccagccattcgcgtttctgcggatcagcctgcgcggaaagatcggtacagaacagcttgaggatcaggttttccagggtcggatgctcggcctgatagcccatttcctgattcagaatgtcccacagaacgccttccaggtcgtggcgtttcagcatcgccagcgtgttttccaggtcgctgtcgtcatctttctgctgattaacgtattgggtaatcaggctgaacagaatctcttccgtttttgctgtttttacgccagcgatgaccgcaaccatcttcttatcaagagaagcttcgttttcttgctcagtgaccaggcctttcaaggcagaaagacgtttagtgctgaaaaatgccttccggcgttgaatgtgctcgcgtaggccaagctgtggaatacctaatgtattcagcgtaatggcggcgaaatcggcgtggaactccgtactataaagacgaatatccaatagccagtcgaactcttttgggggggcatcgtgggggaaccacagcaaaaactgctgttccggctcgtcgatttcaatgcgctttttaaccgccagctgcgactggtcggtcatatcaagcagcgtgacgttttcgagttcgaggttatccagctcttcgaggaaacgcttatcgggatcgtgccagaaaacgatgcgatgttcggcgaattttgctttaaggccggcaataaattcctgattttgcaaggtcacaatcccatttcattccagataaaagttaaatcgtcaggtacgggtaacgtgcggaacagatctttttgacgttgttcacgagcccgctgacccaaaagctgggttagcaaggggtcaattgcctgttcgaaaaacattttaccatgaaagcactgtgttaattgcgtcgttggggagcgtgcggcgatgttagttttttgcgtttgtatctgggctaacaagacatcgggatccagatgctggctccactgccgtaagcattgttcaacttcagcatcattctgtgctgtattaagatcatgaaacgcagtattaaaaccggcagcgcgcagccgttcccaaagaggatggataacattccaaagtgcggcatggttccgccattgaggtaaaacatcatgaacggcctggataaatgcctgtatgccgccattgatcgcctgctgatgttttggctgaaacaccagccaaagttcttccggcgcgatcagataactttcaatacaaaaacgcggaagaaccagtagattagctagatttcgacgcttttcagcgatctgcacgtcagtccatgcgtcacgatcaaccacgcccagccagttggcttcaagggctaacgcctcaagcacatttttcttagaacctgctggtgcaaggatccaatcttgttcccatgccggaaattttctgctgaggaaattctggaaagccgtgacatcatctgtaccttcaaccagcagtacccgtctgccggttgtggccactttttgttctttaatgtcccgaataatttgcttaacgctggccattttccgcatccttgccatcggttaaatcaatccgcaatcccatgttgtcataacgttgccagatatccgttgcgtgtgaagtcatcacaagctgaccatttttcctggcaacgatgttctcaatggatgccagcaacggcgatatcagggacggatgcagatgcagatccggctcatcaatgagtacaacaccgccgggctgtagccagcgttgtaccgtaaacagcataatcagcacctgatgttcgccggagctaagcgcatctaacgaatgatcattccctgaatccagtaggacacgttgccgctgtcctggatgaatttcagcttcgatacgtttaccgctgaagaactggtttagcgtggcgatcatttcaggatattcaccgggcatggttgccttcatattgaagagcgacgattcaagctgacctttccagttatcgttcacttcataggttgccagccaggcttgagttgaatcatccggggacaggctgccgatatctttttgcgggcgaacccagcggcgcgcttcggcatccaggtaaaccagattaggcatatcaacacttggtcccttcagtacaagccgttgatactggctactccagtgactccaccagttcttatagggaagaaaaaagtgttccgatgacgtaaaaacggtcgtctctggcgttgttccctttgttctgcttaccgtttccccgagccagtagacctgtgggtatttctcttttagttgtactaaaaatgcctctgagccaagaaatagccctatttggtcctccgattttggcgaaaaggaatcgagaatcatcgcgcagctggcatcccagcgatagaaccaggtataagattcatctttgatattcaggcgcgtacccgtgcccagccaatgcccaaaggcgcgccataataaggaaatggctcgtaacagcgtcgatttaccgcagccgtttggcccggtaatcaggacattggattctatctcgcctgaccagtcgttttcaaaacgaatttcaccgtcgggcagcggtccgacggattgcgtataaatcgccgctattttcattaaataatctccggtgcattgccggtaatggctttcacatccgccagcagatcgccaaacttaccgtagttaaccttaacgccgtcgtcgagatcaatactgattctcatatcagcatagtggcgcaggcgatcgtcgaagctgcgcagttcgttgaattttttgctcaggctatcacgctcacgtttcaggcgggtggcttcgccgcctgaggctccatcgacctgttcgttcaggcgatcgatattggcctgatagcgcgccagcagcggcactacatattcggtacgcattctcgccagcgtcgcatcgttgtagcgatgcagatagaccaggcactcaaacgctttctctttaccggagctgaacagccagtatatcggacgctttttatacatcttcatatgatctttccagaactgagtggaaagatagcggcggatggtatccagcgcagattcgcctttttttggttttatcgcgtataaacagaggctttcggcgataaattcgagattttcctgcaagtgttcttcgccccaaacggtgcgaacaaactctttgacgcgagaggtaacgtcatcgtcaaaccactcgtcatccatcagcggcaggataccgtcattgtcagccgggaaggttttgtacgcgtcttcagcgaccagttcggcaaagcctttattgccttcatgggcatagaccagtccttcgcgatcgagggagtagcggcccatcatgcagccgatgatgtagcttaagatatctatagtgatatcagtgtaatacttattggttagatcggtatgatcttgaatatttttatatcgatagtttggattacatagtagagttatttcactttgcaatacagctttaattatagttttgtcaagttgtaatttatctataaaaatattatttatagtattttctattaggagaagtgtttcgactaacttgatatttgtattgattttttgtttgtagatattccgtagcaattgagttgaattgtgttcaagcaatggtgaacaaacataatcccatgattgctcttgagagtcccagtcatttttagctatttcaatagcattggtgactaattcgataatttcatcttcaatttctggatatggtactgaggctaattcaccactagtaaagctaagtgtgggggctagtattgataaataatggtttacaaccggagtgcacattaatcccgcagcgtaaagcaactcatttttgttatttgaaaagccgcaacggcctgtatcatcaaaaacaaacccttttggacgatatctcacgcaaaaattaccttggcttatttttgaccatgttatgccttctctaaagtaatactcatcatttcttacggcagagcgagttttgccattctcaaatttaaaatttcgtatttcgtaaccattattttcccaatttacaactatttcgttattaccataccactttcgatattcacctccactactacaaggaaaccatttgatattatgaatgtcgatttttgtatttgattctttatttgtgataagggttttttttattgaaacctcgtaccaatatctttgaaatttaatattgtcaccggtggacatgcctgcttttaatgctattttttctccaagttttttatggtggcgaaaagataatagactcggtaagtctatccaatatgctattggcattcctggtatgtttttaaaatcatgctgtgtaaatttatcaaatatatttttccttagaagtagatcgcttttctttacttcttccctaccatctataagtctaaaaaatacaggttggtaacgttcggagtgttggtttttaatcacccaggcagttgtctgtacaacctctccagaaatttgcccaaaagcccgagctcccaaatgtgccatcgtaataaatgttttattgtccaataaccagttacgtagtgcttcataacttgacaaaaacatccatgattgcatattgacttgagcattaaacccattttctttaagcaaagaaaatgcattctgcataaacattgcaaacaaatcagctttactatccgggaagttatttttggcaaactctttcagctcactattcattcccttgccacccatatacggcggattcgccactaccgcatcataccgctgcgccaggatccacgcctgctgaatatacggaataaacgctttcgccgctgccttctgctggaaatcgccttcctgctccatgcgatatagcgcttcgagaaacgccttcagttccgcctcttcttcctgtggcacctggatcagcgagcccagcgttttggcgttcacaaagcgcttcagcgtgcgcatcagcagctgatattctgcgctgtcggtatgggctaatgctgtattttcggcaaacatatcccccatgctaccagtctggttctgctggtggaagttcagctgctgccacagcttagcaatatccagatgcaggctctcctgcagggagacaatattcagacgcacgtcgcgggtgaatatccggcggtcatcctgacgggccatcattaataaggcaaagccggaaagctgggcagcacggtcgtcaatgtcgagaccaaaaatattattttccagaattagctgtggaatatcgcgggcgcgatagccgcgctcttcatagatatttttcagcacattatagacttcaatcagaatatgcccggagccgcaggccgggtcgagtactttgatgctttccggttcaatactggcaggtgtaatggcggccagctgcgcctgcacttctggcgtctgttcggctggctcaatgtagtagtccattttgcctttcagcggcgaatccgggtaggtctgcaaccactggcggccgacggagttctgtaccagatactgcacaatccagtttggggtaaacagctgggtggcggcaggaatatcttcgctcttcaccaccttaccgataaccgcatcttttttctcagagatatagaactgatacagccagccgataacctcaacttcttgccagtcttcttccggaataccgtccaccagaccgcgtagaatggagtcggtgcgggtcaggttatccggcagcagtagttcagcttcatcgtccacagcttcaaacaggaacggcatcgcgcggtgcagggcgtggcactgggccagcagcagttcacggtagatggcttcgtcctggttgccggaaagcttcatctcgaccagctgcgcctttttctctggtagtaatgcttccgcgacttccggtacgtggtccagcacttcaaagcctgtcgggttatccgggtgcgagagcatgtggaagccgtggtcaagataaccgtggatttccatataacgaatggcgcacaggcggttgaaccaggtgtaggcacagtgctcaaccagcacgtcaaagccctgctcgcgggcgcgttttaccagacgatcgcggcgggtgagggtggatttggggtagtcgaactgaccatagcgcatggtttcgccgacgagctcggcatccgcaatttgcagattgccttttttatcagcggaaatccccagcgtggttagcttttggatcaccgcatcgcggaactggttacgggcctgtggagcgtattttttgatgttattggtattcatagaaaatcctgcaaagggcagcagagcgctgccctgaaatgggggttactgaagacgaatccggtcacctgcctcaatagctgccagcagcgaagtacgaagcgtatccagcgctttttccacctgttcggcggtttccagcacttcgccaccggtggctttgcgcatctcgctggcgacattcaccagatgcgtttttttcggtaccggttggataacgggtttctctaccacaacataagtctgttgtgactcggccgcgcgtttagcttcattcgctgctcgtaactgggcttcctgctttttacgcagctcgtcgatccactggttaatcttcttctcggcatccgtttgcagtgccattgtttcttgctgttccgccagaatttccggaattgactggctgacctcggcacgttttctggctttttgcatcggcagcagaacgctgttttgcagctctgacgtggcatgcgcttcctgcaagcgttgacggctttcctcaatgcgggcgtcaatgcgttcaagggcgtgctggcggtgctgttccactaactgatgattgacgttctggacctgttcaatcagtggtgtgatgcgattgagatgcttataaggttccggcatctgccagatgttttccagctcgcccagtgcttttaccgccacggcgtctttttccagcgcgctgcggttggatttaaagctgccgttcagcgccgcgcctagtttttgccaggtagcaaactgcttgcggtagaaatcgaccaaattttcacgatcttcactgaaatccagaagctcattgacctggctggtgaccttctcaatcagggcaaaatcttctttttcactcagaatggaattcagcaggcgcaggcctgactcaatctcatctttacctggattgtttccaccttccgctttcgctttgaagacattcagctcttgcttccagtcattgaagacctggcggatatgttcaaccagggccggttcttcacgttcgctaaacggctgttgggcaatttccgccatagtttgtgcggccttacgaatttgcgattcgtcgtgacggcgaattttgtgcagacgcagctcgctgtggcgacggctgttattaaacagctcccacacctgcttacgctcgatattgttattctgctggctgaagctgaatttgcctttgcgcgccagacgggcaaccagcagcttcacttcttcttccggccatccataaggacggcgggcaaagtggttcagaatatcgcgtaaataaaccggcttattgaactcgatattcatgctgacccaggtttctacttcgcgcatcgcgtcggggttggattcctccagttcgcccagatccagctccgcatcattctccaccgtgagtagtgcatggatttcacgtgcgatatcaccgttgaacgggcgcagcattttcagcttggcaaacgtgttttcaatcacatagcggcaagcttcatccacgatgctggatggcgtcgaagatttcttcggtaagcgctcgccaatcgcccagacgtcagcttcggcaataagcgactccagctgaacgcggagcattttctcgcgaacgctgttctcacgggctttttctgaaagcagactggcttgttccggtcgctgacctgcgttgtccctgaggaatttttccgtttggacgaccaaatcaatatcggtccaggtccgggcatcggcaggtaaacgaattaaaatgcagccgtctccctcagaggtgtatgggcggcatgccgcgtcgttgtcatagaaatcataggtcggatcttttggcgtgaggatctttaccaccagatcgttaagcattgcgccgtctaacgggtgcccgttcaggaagcggctgatatcaaagtcctgcttatttgccggatagcgatacttccggtttttcagaatgtcatcaaagatgatcgaggccagtttcttgttgatcgcggagaagtcgacttcgacgttacggatctcgttctcgatctctttttcttcgttggtcagaaacacgtatttgtcttcaacacgtgcaatcaacatttctcgttccagcttattcaggcttttttcaacgcgacggcgtagttcgactttatcggtatcgattttgtctatcgaaagggtaaccaggttatctaatgtacttttcagcacatcgacgtagcggatcaggaacagtgttttcagtaagttgccatcgaactcatcaagaatgccattctggcaggcctgagtgatggtgcggctgacggccggctccaggaagctttcaatcgcggcataaaaacgccagaagggaaccagagaatccagaccctgcggggagatctgctgtgccgcagtctggaaggcttctaactgtgagcgttcacccatggctaactgtttaccggcggcacctttggtccggatagactcaaaaaccttctgcagaatctggtagtgccacgggacaaacgggtagttatcaataaattcttcttcgctggtgtaggggcgcaaagaagcggtggttgtgggatcaaaagcaagctggttacgtagaatgtcgcctttttcctgccagactttcgccagcgcgggttttgcggcatcggttttcaccagcaaacgtttttggataacttcggaggtgttggagcttgaaagctgcaaacgggtagagaaacggccttgaattttagagaaatcttgtccgtcacggctgctcatcccaccaatggccgcattaatatccgcctgggaagtaacaataacccatgcgcgtccaccacagataacacccagattttcagtgatagtctgcagcttcaacatcatctgcgtatttttaccgatgaactggccgacttcatccaccatgaagaggatatttttgccgttttcatccagccactctttgacccactggcaaaaattattgatatctaatgggaaattcttatccagctgttccacccattgacgcgaagcgtcaacgctttgaccggtggcctggcttagggcttctgccatttcatcgctgatgaaatagtaggaatcgcgctctttttcccagcttgagtcagtgatagtggcgaatgcggtcttaaacgcgtcgtattggccgcgtttagccagctcacgctccagatgggcgatgtgcggaaaatcagcacagtagccaacccgttcgttaaataccttcaggaagactttaaggatggcgtcttctttgtcatcgacgttagcacgagaatcaatattgaacagaatcacttccgtcggatgatggaccgctttgttgatatcagcgaggaacagagcatctttgattttgtcttcaaagaaggagtaagcatgacgttctgtaccgttatggctgactttgcggttagacaacagatacgacagaatcttgataaagtgtgatttacctgagccaaagaaccctgacacccatacgccaattttgttttccatgcgtatgcgatccggaccggttgccggaacataagattcaaagaagtggcgaagatgcccttccagttcccgggtgatgacgtattcatcaagctcaatccaggcactggcatcgtccgtctgttcggctttcacaacgccattaatatttcggtccagacgtttctcaaagatctgttcaatattcattgctgtgctctttaacgaggattcaatgtcgccgcaggcccgctttcgggtaccagcctgaaggcgcgataataatttcgggaatcaatgcccgccaatggggagagatcgtgtccgctataggttcccggataaaacatcagcaggggggtaaaacccatcacgtcctgcaaggcgctcatcagctcatggccacgaaccagcggccaggcgttacccattcctgtcagaatgacaaactcttgattctgaagatcgactttttttgctatgtaatccgcgatctttttctgattcaataagccaacgagttgttttttcagcgcttcggtaccgactttcacttcctgctgacagacgcggtcaaataacccacgttcagtgagcatgtcgacgatgatctgaaagatgttgaggtgcgcgaacttgtggtccttttccagattacgcaacagatacttcaggtgttcacgcacctgcagctcattctgagcaggataatcaaaaatccagaacccaatctcattaccggagccgttgtttttgagaaagcgctcttcgctaatgcggctctgaacctgtgacaggcggtattcaagcacgggatcgatcaccgttgtccctccagaatagaaactaattcttgttgtccaaggcgctgcaaggtcgcctgagtttctggtaaaagaaagaccgactggagattacgccgacgaggtgtatccagataaccagcttcagccagtgctttgatcaagttgttacccatttttttgatggatgaatctgagtaactggtgagtacgggctgctgacgaagatggttagccacaaactcatcccagctatccatagggagcttttctttaaattgtctgcacaggtcgttcaccacttcagccaggaagtctttaacaaccggtgaatggaggatcagagcgacgaacagcaattgctgacgctcgcgctcgctcccttcagcaataagcgaccacgccactttatcaagcgtattcaggcgtagttttatcgttgtagcatagcgcttcgccgtattggcagaggaagcctggagaatgttatgacccacgatctgctcttgccaggtttgttcattgggagcggtaagcatgagctcagcgatgattcgactttccctgctcatcagcggcccgcctagcaggtctccaatccatgccttgtcgtttttcatcgtcatatctaccctctgaagactgctatgcagctcgcaaaaaaacaaacgatgattgtaatgggggaaggggcgggatgccatgagaaaaggcaatttgtgagatgaaagccattacggagaccggtatttatccatccctttgaaaaaatgatttttacagtttgttcattgagttactgatttgacagattattcggaacggtaagtcatataaatcttttgtacttcggggtcatccaggctttcataagagatgttctttttatctaaaccatccagccccttgatcccgccaataatagccagccaggcactccggtctgtgatgctcacaacgaatggttccaggtaacgatcaaggtgctttttggatggttctccgatttcgtcgctgagtgccttcaaatagtaggtaatcggccacggttctcgcactatggtctgtagcgcgctggtggagtcacacctgtagtcaagtgacgcgtagagcgccagatgaaccattacgagcgcaagcagaatttataagggcggtgccttaaagagcacagggagattgtaagtagcccgatattgctggcttttgcttagcttgctgacgggattcgtcgtatgaaacatgaaaattacctcatgttttatataaggattcgacactatatcaaaaccggtaactctcaatctttcaaagctatgtgtcagatcaggtcgtgataagacacataaatttaaagatctatatatctggccagatagacttttttataacagctttataaattaaacaaatctgccatagagacagatttgtttaatttataattagaggtttgcaacgttatgatatactttttgcacatcatcatcatcttcaagggcatcaacaagtccttcaaagatttctaaatcttctggtgaaagttcaacttctgattgagcaatcatttctaattctgttgttgaaaattcagaaattccagctgcttttagcgctgcgattcctttatgcaggtctgtagcttcagtataaataacgatgtttccttcttcttcggttacatcacgaacatcaacttcagcatcaagcaaaatttcaaaaatatggtcagggtctgttcctttaaatacaatcactccagtattgtcaaacatatagctgacagcacctgccgctccgatattcccgccttttttattaaaaattgtgcggatattagcaatcgtacggttaacattagacgtcaacgtttcagcgataaccattgaaccattgggtccaaagccttcataacgcccttgcacgaacgtttcatctccgccacctttggctttatcaatagctttatcaataacatgttttggaacctgtgcttgtttcgcacgttcaataacgaattttaaagctgagtttgattccgggtctggttcaccttgtttagcagcagcatagatttctacaccaaattttgcatatactttagacgttgcaccgtctttagctgttttcttagcaacaatatttgcccatttacgtcccactggaaacatctcctcaaaaaattatttacattaatggcaggttaataacctgcatgtttttctgccgtattatatcataatatataaattctcgtctatgagaaataaaaacatccagcttttacggggggttactttgattttaacaatggctaatatggtgggtaagccattttttaattttcttctggttctttttttatttttaataattgaattgcagcaataacgtcttattgatggtggtgtcgctcatcaggtgaggtggaacgcttgcacgtcttgcgacatattgtggcagaaacttaatggcgaaattaagagcctatcccattagggctattttacttgccattttggacctgggcagtgctcaaaatcctcacgtactacgtgtacgctccggtttttgtgcgctgtccgtgtccaaactggctgcgccaataacgcctggtgggatagtctctaaggcgatatattcccgccttgagccgtgttaatttgttggatacttttaaatggaggtatacctcttgtaggctatacctcctgcttcacgttatcgcgcgattaacgcaaatacgccccagccaaagtattctcgcgtccaggtgacgtgacgtttgggggctaccgtcagttctgttcgaacctcttgcgcaaactcatcgtcagggttttcctccagccagcggcgcatggtcatccacttcgcggcttcatatctgtcccagccttgcgggtccgccagcaccatttccactacgtcatagccgagttggtcaaaaaaggcgaccagctcgggcaggggacggaaatcggcgacggatgagacgccacaggcgtgggcgatctcttccgttgcggggatccgacgccagtacggttcaccgatgagaatgatcccgccaggtttgaggcttttggccagcagatctattgtccccgcgacaccgcccgcaatccaggtagcgcctacgcaggccgccacgtcatatttttcctcatcaatataaccggccgcgtcgttatgaataaaatgtacatattcactgacgccgagctcttctgcacgttgttttgcctgtgtggtgaagagcgggcttatgtcaatgccagtacctgtaacaccgtaatcgcgagcccaggtgcagagcatctcacccgaaccgctaccgagatcgagaatccgcatgcctggtttcatgcgtaacgcatggcccagcgtggcgtacttttccgctgtaaacggattatggatacggtgttcgctttcgctaatggtaaaaatacgtgggatatccattgggttattccttttactgagggcaataccctcagaagtggatactttttcaaccagcagcgcaaacagcttgcctgcaaaagtctcgccgaccggccaggtgtgactgtccgggcgctgcaacacagtgaagccagcatcaccaagcaggctgatatattcatcatcgcgccaggccttcatttgactgccgaaacgggtggtacagccgttttccgctatcgcccagaactgcgttgagctggtttgggcctcttcatcccaggcattttccgttaacagcagatgaggctcggcaagaaacaggccgtgcggacaacgctgccagcctggctgcgccatgccctggcgtttaacttcatcgaaggtatgcacttcaacaagcagtttgccatcgggtttcaaccactgagcgcaatgactgatgaggctttgcgcatcagcagcgctaaagacattcagttccccaaacgtcatcataatgaaatcaaaaggttccgtggggtggtatgtacgaatatcctgctgaatgtagtcaatattcaggtttgcggcttgcgcctgctggcgagcccatgtgatggatgccggagagaaatctacgcctgtgcagtgaaacccacgctccgctaacaggcgggtataaaaaccggggccacagccgagatccagaatgcgggcgccagcgggtaactgacgggtaatccatgttacctgttgctcaatcacggttagccggcggctggcccagtcgtggtcctgcgacagatgattttccagcatgcgttggctgaaggctggctcgtcccaggggattttgccttcatcgggtaatagccgaatgcgatgcgttgcaaaaataacggcgctgatatccatcatcatctccttagcgattgtcaggctgggcgcgaacgttgttcagcccggttgtattaatgcggtagggctgaccgttaacggatttgatcagctttttggttttgagttttttgaatacagcgagcgtgcaatcggcgagcaacagcccttcgcggctatagcactcaacggcggtgacgcggcctgacgcatcgcggatgtgcgtaatgcgtccgcctttggcgagaacgtgtaaggtacgttgttcctgacgggataaattcatactgaagaacctgtttaatcatcataggctaaacgtgcaaacacactgcggtgtccgcattcgatttcggcgcattgataatcagtccggcctgaaaaggtcgggtaactgattatcagatgatgacattctccagcatcaaagcctcgggttgagttgaaaggtatttacgtcgtgaatgataacacctgatttctgtaagtgaataaccgggagtgaaaagtgtgatctcaaagggaggctcatgacgtttagcgtatcagatgaatagctcccgcaattaccataatgaatattgattaaactcatatacccgataatgaccgctttgatagtctcggcgtatctttttagccattgacagggttgttgcgttggaaatctttttttaaccaactgaaaaatatcacttaaatatttttcatacataaacatttatggtccgctgagttcggatccggttttgtatgggttaaaaaaggtacgttatgaaagtcatatggactgtcactcctgtggggtatcagcgcatagcgaaacgttgcccttcatgcagcgtaaaacgggacttcacgccttctggggcatttcgggttaattcgcaaaagaaggtactcgatgtctggagtatctataaatgcacacactgcgattacacctggaatatctccctgttctcacgcctaccagtcagcaaaattaaccgcgatctttattgccggctgatggcgaatgatgctgccacggtgcaatattttgcttatgacaacgcgatcctgaagcgaaacaatgctgaattatcggggcagcctgattttcacattcaggaacggtggctggtcagtatcgcctcccacaagcaggtcagtgttagcgtcaggatttcccgttcttttcaggtcagcctgctgtcgattttgaagaagcaactcctgctaagcgcagccgaaatcaagagacggattgaaacagggcaaataagtggcgtcacgatgaaaatgcttaaatcgcgaaaactgaagaatgcgaaatatgatttgcagctctcagttgaaacactgtatgaccggcgaaggattgttctgacctgtcgataaaaataataagctcaccttacgtttaagtgtgctggtatggcaacgacgcaacggaatgaaagaaggattaagggacaggtgagctttagttgaataacgcttgtctgtggcattcagtgaaggctgaatgccatggataatccagattttcgcaccagtgatgatattgtatggattctttgcgcaagccagcagaatgacaaagggcgatgggttacaattatctgtagagtaaacaaaaggaatataatgtggcgctatacaatatctctgagaaaatactgactacccttgaaaaaacatctttcaccatcgaaaggctgcaggaacgctatgatcttcaggaggctatcaagaagaatattgatattgtcgcgccgggctgccttgtcatatccgaagaattctctgattgggaggatagtcggcggaggattgatttattagcgattgacaagcaggccaatttggttgtcattgaactgaaacgtgatgaaatcggcgcgcatatggaactgcaggcgctaaggtatgcggcaatgatttcaacgatgagttttgcgaaagcatgcgaatattatcaggcatatctttggaagcatgggatcgatgagaatgcaaaagagaagttactggattttgtggagttagaagaaaacgaactcgctgattttggtaaagatattcgcatcgttctggcatcagcggatttcagtaaagaattaacgacaaccgcaatatggctaagagataaaggtgtcgatattcgctgtgttcgcttaacgccttacaactttaagggtgaagtgctgattaatgctgaacaaataataccagtccctgaactggaagaatatcaggtcagattcagagagaaacgcacggaacaaattattagcagtcaaaagtcggagagggattattccttatataaatataaaggaaaaaccttcaataaacggaagcttgcacttgaacttttcactgactggattaataaacataatcctgcgaatatagatgatctcaagaataaattgagtgaagacttacagaaaagaacagtagcactggttgagcagatccctgaaaaaaggaaaaacagatatcatatgcaggaagatgcgttgattgagttgccgtccggtgagcgtattgctatatcgaatcaatgggggttagggactatagaactgcttattgattttgttcgtcaggataattttgtagttgaaaaagtaggttgacaggaagtaataataaaatagatcccattcattaatgggatctcacgtttcatccgatacgaagaccatggtctctttgtcagtagcgtcataattacgcaagcctctttactttgcttatcatttatatttaatgtaaatattcacgcaacaccattaaaaaataagaaaaaatggctcactgttgaactgatattaatacctgaaccactgaattagagtaatgtggcgctattcatagcgtaattttttctgttgcggttacagggggaggaatgcacacctttagaccatactcactaaggcatagcgatctgttatatgaagatattccgttagaaatacgcgagcaaataatcttattgattatcaatacgctaggaaactgctcctctttttatgatatgacattatactgctatcataatagtcattctgacgaagtttatcgaagaatatgtaaaacgttgcgcaaagagtatggcttattcaccttatatgcgcattcaacgtcatatctggatgaaatgagtaatctgttattaaaaacagatgataaaagaaagcatattgataccattgagcttgcttttaactatatagatacctaccttcggacctatgaagttacgcttgggttagaaccggataaggcgattagtgaattaaataatatatttcatgagcatagtttaaaatatcgatatgaaaatggtaggattgtaaggttgcgcagaataaaacggcttaaaaacatatgttattatttgtactcccctggagagtatggctttgtcgaatatgatcttatggaagcgtataatcgcctgatgcttaatgattttgcctgtgtcgtaaaggaatgtcatgcagtcttcagaagcgttcttctcagaattcatgagagaaaaggtatcgtatatcatgaacaagatagtttaaataccttaatgactaatctgatggcgagaggcgttatatctgctgaatatgcacataaatttcattttttaagtaacgtgctggagtcagaaatatttctgccgatggcgccagaaaaatcgcatcatcactacgcaatgatgctccgtatctctgaagagttggcctgtagtatctattatcttactgagcggagtatattttttcttacccagcgggctgaagaagacagtgtcgcgccataataatgatcgcgctgtcgctcagtcagactggatcatcgttatttaaatttgttcagacgtcggaattttttgttctgccgtctgtttttttagtgatgagctgttcagtgcaataataaggggtacagtacgatgactgatttttaaactgcatatcatctgtgtcgcatttactcatgggtattgggtcagggagagagaagaatgagcactattttaaagccttttttattggcggtaaccctgatgttaatcttaataaggcctggctttgcaacggaggatggagcgataaccatggttaaaacctacagcgcttatgactatttgcagacccgagcgcggttgatgcacgctgtcgccgatcacggtctggtgttatttggggaatttgaccatgccagagcggcacagaatgttaacctgaaaatgccgccgacaacggttctggtctttggcaatcctaaaggcggaacgcctctcatgctggcgcatcccgaactggcgctggatttaccgtttcgggtgctcattagccagcaagccgatgggcgaacgttagtcagttatcatcccgctgaaacgctgcaacgttatggtcttgatgccgcagacatacaggctttgaaaaaactggaacagctcgttgaaaaaagtctccactaaagctgaaaatcgggcgatgtgtttgcacaagtgatgtcgcgaataaatgcggtcacatcgtccattacctgatgcgataaggcggcatcgaaggtggcgctatcagcatcacagaacccgtgccgcgcatcgtacattttacactgcacccgggggcgcttttccagcgcctgccgcatggcgaggggatcaaacgctggctcataacgcgcgacaataaccagtgtcggacagagaggcgcaagatgaaggtactggcgtatacgggaaccgtaatagcaaacgacgccatcgcataacccactggctgcacttagccatgcgagcgttgcgccgacgctatatcctacgacgattagcgtctcgtactgcgttctgagatcgtggagtaatgtggtaacgacggcgggatcaaagccgacatttgctgaaaagtgacggtaagcctcctcctgctgttcatagcgaaagggggtatggtgaggaaacagcgcgggaatatagatgtcgaatccgcgcgtcatccattcatggcctgcgcgttggatatgagcgttaataccataaatttcatgcagaataatcgctgcccggcgatggcggctcgacaaactggaggcgttgcttcccccggatacgcctggggcgaaaaacacggtgtcttttatcataacgcgttcttgatacaaagagagcggctggattttcgccgatcacgctatgtcagaggcattattcctgtcaatgtacagacacattttatggcctgatttttggttgataaattttatattggtaaaccaatatgctgttcatattcaggcatcagggctaaaggtggaacatcagtcgtgtattgtctattgcctttcctttcatctggcctcactagcgaaacggcgcgcattattattttgttggttgaccagtttcgcgtttttggtgtgctacgcgtgctatccctctttacaaatgctatagtctgataccgggaaatcgcatcggacgggcacgaccaatatgaaatcaaacacttctcagcaaagaccttaccaggaagtgggcgcaatgatacgggatctgattgttcagacgccgtaccgccccggggagcgcttgccgccggaaagagagatcgctgagaggctcaatgtgacgcgtaccgtcgtgcgtgaagcgctgatcatgctggaaattaaaggtctggttgaagtccgccgcggcgccgggatctacgtgctcgacagcgcggataataacgagatggaaggcgctgacgtcaatcactgtaatgacgccgggccttttgaactgttgcaggcgcgtcagttgctggaaagcaatatcgctgaatttgccgctctgcaggccacccgcgaagacatcattaaaatgcgccaggcgttacaactggaagagcgagagctcgcctccagcgcgccgggcggctcagaaagcggcgatatgcagtttcatctggccattgccgaagcgacccataacagtatgttggtagagctcttccgtcagtcctggcaatggcgtgaaaataatccgatgtggctccagcttcatagccatctgggcgatacgctttaccgtaaggagtggctggtcgatcataagcagatcctcgcggcgttaattaagaaagacgcccgcgcagcgaagctggcgatgtggcagcacctggaaaacgtgaagcagcgtctgctggagttttccaatgttgatgacatctactttgatggctatctgtttgagtcatggccgctggacaacgttgatgcctgattatacctggaatagcgtgggcagacccagtccacgttttacttcctgtagcgtcttttgagtgacctcatgggcccgctcgctaccttttttcagtaattccattagcattcccttatctgcaataaaggttgcccgtcgttcgcgtatgggcgcgatcagttcttgcaggcaggtctccagctcatttttacagacacggtcgcctaatccgccttgttgataatgtgctttcatcgccgcgactttggctttatccggatgaaacgcatccagccacgtaaagacgacgttaccttctatttttcccggatcgctaatttttaaatgattgggatcggtgtacatcgcgctgaccgcacggtggatggtctcttcgctggcggaaagaagcagggtattgccgagcgatttcgacatcttggcgctgccgtcaatgccgggcagacgacccgtatcgctcaggagcgcctgacagggtcgcaataccggcgaggagaaaagactattcatcttatgaacgatctcattcgtttgctcaatcatgggcaattggtcgtcgccaaccggtaccatttcggccttaaaggcggtgatatctgccgcctggctaatgggatacgccatgaacccgaccggcagggaacgggtaaagcctttttgggcaatctcattttttaccgtaggattacgctccactcgggcgacggtaacaatattcatatacagcaccgttaattcggcgagggcgggtaacgcggattgcaggcagatcgtcgtcagcgtgggatcgatgccgacggccagatagtcagctaacacttgcggaatattatcgcggattttttgcggattactgccgttatcggtgagtccctgcaggtcggcaatcaggacatactgttggtgatcctgctgtagcgcgacgcgctggcgcagtgaaccgacataatggccgaggtgcagcgagccggtggggcgatcgccagtcagaatgataggaagggtgttcattaaggactcctttatgcttactgtaaagccgaaagacgtcccgaaacgcagtagccgcctttcggcggctacttaaagagggatagtgatccgtgccgccttcaggaaggcagccaccagcggagatgacgttgcgtagcgttggatcgtttcgtgttcatgtgatctaacgtatcacgactaaacgtaagggtaaagcggctggcgtatcgtccgggcataaagtcatatcgcctgaacagataacatctcactgactttgaaacgcgattttataatttgctgcccaaaaatacgtggcgctgaaaggcgcatttttgatgcaaatcatttattactgtgataacactgcgcgcgataaaaacattaaatatattcacatagtaaatatgttctattggaatggttgttttcgatatgacaaaagtctaaaaaacccattgatgtgaaaaggaataagaattgtctatattccgattcggtggaattaagtaatttctcggataaaaataagaaatgatattgatatttcttttttgatatggttcttatagcggctatggttattcaggaaacgatgcttgaatgcctggcgtaatagatttcaggtcagtagcgctattgtaaaatggattgttgatggcagaaggtatttagcaagaatccagttatagcagattgtcggtatttaatctggtatacagagacaccaacgaaatggctggaaaatggaacgttctttcattgttggcgttccgtccttgtcagcctgctttgccgcatgataatcacggaggggggatggacgccatctatttaaaactggacggtattgaaggcgaaagccggatcaaaggttttgaaaaccaaataaaacttattgcttacaaccacaacccgacaaaacgggagtccggcgaagcgagagggacatatattggagggttgacgctgacaaagccagtcgatcttgctacaccaggcctctatgagcactattgtaacgggaaaacggtgaaagaaggcgtgctgacattatgccgtcgtgataagggcgcaatgctgccatttattatttatacgctcaccaatgtgcgaatttcacgcatgagcaatcatggagacgccgaaggcagcgccacggagaccgtggatttggtttatagccatattcgctgggatattcccgcattagcgtcgaaaagcaaaacacggcggcctcttcaccgacaggcgctgtggcgatgaggacaaaacaagcttgcggactcgcagtgggcgatgctgtatagcgaaatggcatttagcggcttgcgaaggctgatgagcgctcatgtaaccaatcgattgcctgaaaaggcgataacgcgtggcccttacacccgttatgatttttacgcatagccgctaataaaacggcattttttatatacacatcaagttgatagtgtgtttctgaccttgacgtaaataagcgggaaaagcgatgaaacacaccattgggatactgggggggatgggacctgcggcaacggcggatatgttggaaaaatttgttgaattgcgacatgccagttgtgatcaacaacacatcccgctcattgtcagctctatccctgatattcccgatcgtacagcatgtctgttatccggcgggccttcgccataccgttatctggagcgttatctgcatatgctggaagacgccggggcggagtgtatcgttatcccatgcaacactgcgcattattggtttgatgatttacagaacgtcgcgaaagcgcgaatgatcagcatcctggacgctaccctgggggatattccgccatcggcgcggcacgttgggctgctggcgaccaatgcgacgctggcgaccgggttatatcaaaagaaagcgctggcgcgggggctgacgttaattcagccagaagacgcggggcaggcgttggtaatgcaggctatttatacgcttaaacgtggcgataaaactgcggcgcaagcgctgctgctgccgcaaatcgatagccttattgcccgtggcgctcaggcaattatcatggggtgtaccgaaattccgcttattgtggccggacatgaacgcgcgatagcgtgcccgatgattgattccacagcgtcgctggtgcgcgcggcgattcgttggtatgagtcctggccagacacccgcgcctctttgaccggggagcaacgccttaccgcctgaggtgtttacagcgcggcctgaagcccacgcaggtcgcgccaaaatgtttcggctacctgactcatgcgggtattcatgcgataagcataagcctggatcgggataaccagttcgtcggcatcaagcactatcaggcgcccgtcggtaatctcctgacggatagcatactcgggcaaccaggcgattccgcagccgtccatcgcaacctgttttaacaattcactcatcgaagagacgaaaaatgtactgaaactcagttcagcatggcgagtcagggtacgatttatcaatcggcccatataggagttctgactgtaattaagcaggggaaagtgcggctgctcaagcgtatagcgcggctcgccccggccattgttggcgcaaaccggaaacagtctcgactcaaacaggcggatattatcaaacggcgcttgttgcaggttttcatcgtgataagaaaagataaaatcgctttgcccctcacgtaacatatccaccgcctggtcgacatctatcgcctcaacggcgtaggtaaactgcgtaggcatctgcttaacgatggtcggcaacaggccgagggagagcgagtgggcggcggcaatcttgattttacgcagcgtataatcgctgccgccgcgcagttcggtcagattactttccagctgctgtaacaggtggcgaacctgggagtgaaagattttaccctgttcggaaagctgtagcggcgagacctgtcggttaaacagttcaacgcccacggcatgttccagggcgcgaatccgccggctaaaagcgggttgcgatacgttgcggataatggcggcctgagagaaattgcggcacttttccagcgtcagaaaatcatatagccattttgtctcaatattgtgcaaacctgctccagttacatccatttaccgttatcctgtcagccgcccgaaggggcattctacgtccattcgggcggctgacaaccgcttatcccatcctctttcagaatgccgtgatggggcagcctgaaactagcgggaattacgccggttcaaaggtaccttttacgcaggctttcccctcattgaccatgcgtttgccgcgcgcatacacctgctcaatgcgtaaatctgcgctaaagacgagcagatccgcatcgttaccgggacggatttcgcctttgccgtccagactgaggaaggcggctacgctggtcgtcagcggacgcagagcattggccaggctgaatccgtagtggttaaccagcgtctgcaacgtctccagcaaactttcgaagcccgcgacgccgatacccgtcagatttccggcagcgtcaaatagcggctggctgccgttaccgtctgaactgagcgtcacccgggaaagcgggacgccggcttttaccgctctggcaatgccctccgccggcgcgacgggatccggaatactggtggtaatgtcgatcacgccgcctttaagcgcaaacgccagcgcctgctcgaaaagagattcgctacggttgacgtgggtaggcagcagtttaccgatcggcacgtcgctgttttccaggatgtcatacagcggctgtaacccttttttgctgctgcccatatgaaaaacgctgacaccaggtttgccccccagcaggccgccaacgcgtgattcggcggccatgctggcgagttgattcccgctgggcgcggcggaacggtggtcggagactgcgcatttcacgccaatgacgcggtcgatcagcgcgacgtctttttctaccgagccagtaatggtcggcgacggaacgtgataagcgcccgtgagcatccaggcggtgatcccctcctcatttagcgctcgcgttttggctaacagcgacgcgggatgacggctgacggagtcggtgccaagcaggccgacgaccgttgttatcccggcttccgtcaggcggctcagagagacttccggcgtccgcgtcgtcggccccgcttcgccgccgccgccgatcagatgaacgtgttggtcgataaagcccgggcacagcatacggccgctaagattaatcaccgtacagtccggtacgatatcgccggggatgccagcgccgacggcaataattttgccattcgcgagtagaacatcgcagatgccccggtcttctggcgcaaacaggtgcgcaccctgtaataaggtaaactccgcggcggataaatcaggcatgataactccttattaaacaataagctgcatgacccagatcgacagcagcgcattgatggcgcagactgcgataatatgcgggtaatatttggcgttgacttcggcagtaccgagacagcggccgacattctgtaccgggtttcccatcaggtaaatggctggcagtagtacggtaacatcgtggccgcttagcgcgccggcggtagccagactggccgccacgccaacggcgccgcccatactcatcagcgaagccagaagcaccgtagccgcttcgccgggaagcccccacaacgccatcacgggctggcagatatggcctacccagtcgagcagaccggtaattttcagcgcctgaataatgacaaatgccatgaccacattgggtaacaggttggtcgtggcgatggtaaaaccgcggcgtgcgccatcgataaacatatccatgacattcttacgtacctgagtcgtcatgattgggctccttgcgcagggtgacggcgttcttcgatgttaatccagatgcgcaaaaggtttgcgccgataaatttgaatagcagaatgaccaccagcggaatgatgactgacgttcccagaaaggcgaataccgcaacgccggaggagaaatagttggtgataatagcgctgccgctggtctgccaggcggcaaaaatcactttatcgcgttcagtgatttcgccttcctgcgccagttctttggtcatacccgccgcggcgtcggtattttgcaggttggcgatcagcgccagtgagcaaatgccaggaatgccaagcaacggtttcaggatgggcgtcatcagttgctgcgccgcccgcagaccgcccagtccatccgtaatcgcgatgatacccagagaaaggataaccgacggtgccagctccagcgcaaaaaggaagccatctttcgcgcccgttccgcccgcgccacgaaaggtctgcgtaccggtcacatgaccgaatgacccgttgagtacggtaaaatcaaaaacgcgccaccagccttcgcttccggaaaatacgccggaaaagaaaataatggtgagaaaaaacgccaggtatccctttatcccgaccttttctgtatcaagcggcatggccgccccgtccacttgttgcgccatagcgatccccgaatttttttgatgatgtgttggttgtagccacaggccaaaaagcccgaaacagaaagaccttatcagccataagggtaaggacaaaatgcaagtatgtatcgtgctatgcgtttcttgcatagcagcgcgaaaaatcaccatcctcgctactgccggaggcgcggggaaccgtggacggtataacgcgaggtaaaaaagcaaagaaacaggtgttgacgcaggccggagctgggagcaggaaaaaaggagaaataaatttgacgttagtcaatttcacgccacttaattatcgttgttaaaaaataggattttttaacctaaattttacttttttactgtaatttttcacgccttaagaggaattgtcacggtcaggtcagtagccgctgataggtcagcttgcgccctaagaatcctacgggcaggtaataaaaaacgaataatcgaattaatttcatgatgtgatttatttataattgtgatgatttgagagggagcgataatcatcataatggaatatatagccaaaataattcgagttgcttaaaggcggcaagggagtgagtccccaggagcatagataacgatgtgactggggtgagcaacggcccgtcagggcgaggcccatggatgggccgggtaatccgtagccaacacataagccacttgaagtaggaagggtatataaaataataggcagattaataacactaaaaaccatagaataagtatagtttttagtggcatctttaccttgaaataacgtgttgaggatgtgctattaaaaacagatcctcattgcgccgcgaatagcattaaagatacaacccggtgcggagagcgtgggtttactctaccgcttattcacgtatcacaaaccgtttttgttttatctgctgcacagcgctgatcagcgcggcaaaaaagagcgccgcggcgccgcaaagcgtggcgttgataattgccgacgcgccattgcctgacagactggcggcgagcggaccgagaatttgcccaataccatacgttagcgtcaccaggcctaacaaattaatattacccggcgcgctgagttgtcgggcaagcggcatcaccagcgaggttgtgcccataaacgtggcgccaaaaccaatactgctcagtattaacagcaacaacgagtcgctggcgagagacagcagcacgcaggcgctctggatcaacaggttcgcggtcaggcatggcaggacgccccaatgttttgccgcccacagccagccgaagcagccgggaatgatcgccaggccgaccaacgaccaaaggtgcgccgtgagtagcggagagcccgcgcttttcgccatcagcggcaaataggtagcgacaatgatgtagccgaatccggcgaaaccgtacaacagcgccagttgccaccagggcataggctgattttcgattcttgctaagggcgcaggcggcagcgcatgagcgcgggggggaatcaatattgccacgattaatagcaatataccggcgagcgccccggcccccagccatagcgaatgggccgaaagcgcataatgtaaaccgccaatgacatattcgttgcccagtgcaatcccggccccgacgccggaaaagagcgcggcgatcacaaacggatggcgggtatgatgcaacacaatcattgatccaaaaatcatcattcccgcgctcgcgacgcctgccaggaagcgcaccaacatgacgaccgcgggttgggtaaatatcgccatggccagaataagaataccggtggcgaccgccgaagccagcagcatggggcgtagacgagaggggagatgaaaaaggccaaaggaaaacagtaagcttcccgccaggtaccctgcataattggcgctggcaatccaggagagttggttaaacgttagctgcttttccgccagcattaccggcagcatgggcgtatacagaaagcggccaactcccatccccagcgtcaataccatcataccgaaaagcgccgtaaaaatgggatggcgaggtgaagcgctctgagcatgaaccatggtttttctctttgctaaagtaaggcaagaatgcctgattgttgttgcaaatgataataaaaagtaaaattaatgtttcaaatttgcaagaaaagaaagtgaagcgcaggcgaataacggattgagaagaggggcatcggtgggaaatggcattaaattaatgcctcccacgtgcggggtttggcagttaatctgaacgagaattgcgccttccccttcttagatactgagcagtgccggtatttgcgacagtaaatataacaccagaccgatagcgccgccgaccagcgtgccgttcacgcggataaactgcaaatctttaccgatattaagctcaatctgctgcgacatatcgcgcgcatcccagccttttacggtatcgctgatgtggcgcgtcaggaaggcggcgaattccggcgcgacgcggtgcgcggcctgttccagatgaccgttaagcgaagcgcgtaatgcgtcgtcggcgatcagcgtctcgccaaaccattgtccggcatgagcgatgcgctgcttcacctttgagtcttcggcgttgatatctgtttttaaccactggcgtagatccgcccagatttcgccgagataacggttaaacgcctcatcttccttcaggtaacttttaatgttttctgcccgggcagccatttccggatcatgtttaagtttatcgatcagcttatacgtcgcgcgatcgaaggcatgacgaatctgatgcgcgcggtcgtgactgatatcatccagcagagaattcaccgcgtcggagaccagttcagcgctgtgttctcccagccattcggtcggcagaatcttcgcttttaacggatgttcggtctccagccagcgtatgatctgtctggcgataaatgttcgggagctgtcacgctgtaacagggcgataagctgggcgatcagcgtatcgagtaacacctggtgacgatcgtttttggtcatgctttccagcatcagggcgctggtgccggaaagatccactttatcaatcgccttatgtaccgctcgcttgagcagccgctgaatacgggcgtcatcggttagttccagaaagccgctcataatttgcagcagatgctgcccgacccggctggcgttgtccggctggctgaaccagtttccgataagcagcgcgggttcatggcggcggattagcgcgatcagcgactgcgtatcaaggaacttctcctgcacaaattgcccaagattttcgccgattcggtctttattacggggaataatcgccgtatgtcgtgaaataaacggaatgggaatgcggcgaaacagcgccaccacggcaaaccagtccgccagcgcgccaaccatcgccgcttcggcaatagcttttgcgcccagcacccaaaaactgggcggcaggaaaagcgtggtcacaaacgtcgcggcggctatcagcaacagtgagagcgccaggcgtttggcgcgtttgagttcggcgattttattcatagggttaaggatagagccagacggcaggaacgtgcaaaaaacatcagattatcctgtgccggataagcctctatccggcagagtgtttacttctcagcggccagttctgccgcctcatgctggcgcacgcgctgtaatagtgtcgccagagtgaagaccacaatcaccccggccaccgctgccagcaggtgaaacggcagtctcccgccgtgaaaccacagccagcggccaacttcgaccgacaccgccatcaccgtcagaatcaccatgttcagcgaggccgaaaccgtcccttttggcaagttgttggaaaaaagcgtgaagcgaaacagcgtcgggaaaatcatgccaatgccgaacgcgtacaggctggtgcccagcacagaccaaagccagacgtgcggcagaagaagattaccgaggagtaatgtcgccagcccgcttaactggattggtacggcgcgccagataaaacgcggtcgggtcggatctttcaccaggcgcacaacgatcatattggccacgatcaccgcgccgaatacgggcacctgcgcccaggcgaattgcgaagtactcatcccgccagcatcgatcaggatcaccggcgacaccgccacccagctcatcatcgggatgtagctcaacgacagcgtcgccgccccggtgagaaaaatcgggttgcgaaacacattacgaaaatcgcgcagtacgctcaccgcgctgaacggcaccgcgccgcgttgcaccgtttccggcatcgccagcagcaggccgcacaacgccaacagtcccatcaccgcaataataccgaacagcaccttccagtgaacgaagtgcatcagcgcggcgccggagagcgggccgataaccggagcgaccagcacaatggaggtaataatcgccatcagcttaatggctttggtttgaccgaaggcctcctgtaccgtgacgtagccgaccgttgcgataaagcaaatgctggtgccctgcacaaaacgggcaaccagaaactgcgtcattgaggtcgtcaacagcgttgccgcgcaggcgagagtaaaaattaatgcccctgcaatcagcactggccggcggccaatcctgtcggatagcggccccagaagccattgcaacgccattccgcccgccagatagagactgaccgaggccggcgcaagactgacgtcagcattaaaatcgcgcacgacgttaatgatgccaggctgaatcagatccgtcgtcagataggcggcaaaatcgtacaaaatcagcgccatcgggaaaaataacgttgtggcgcgttgggagaaaaactgaataatccgttgcataaaaaatgcgctccatgtcggagaaccccatgatgggatagcgaaactcaataccgtcatcgtgacgtcaggcaggcgatagaaacagcggctgcggatgtactgaatttcatgtaatcaaaaacgctgccggtgaaaacacagacaggaagagacgcgttctgaatctcgtcagaacgtgtggcgattacagataacaatcagcacatcacacctcgggaaatttacgttgcacggaaaatatacacattaagtgtaattaaattttgatgttaatcaaaagagtttgtctggttaataaagataaaggcagggtgcgcaggctggtattttgcgtgctcagttccgaaaatgcatgtgcattacagataacaggatttatcttccgtcgcgcctcgcaatgctgaaaaggtacggatgagaaaggaattttcaggaggtagagtcgcagcatcctggtttggggggacggagcgccatgaaaaaatcgacgacctcaacaccgcatgatgcggtgtttaaaacctttttgcgccacccggaaaccgcccgcgattttatggagattcatctgccggtgtcgttacgccagctttgcgacctgctgggactggttgaacgaattgcttcgctgttagttactggttgcgctaatgacaggcagcttaaagcgctgtttaattatcttatgattcagcacggacatacgcctcgtttcaccacgtttattcgtgatgtggtagggcatgtcccgcacactaaggagagactgatgacgctgatagagaggatccgcgcagcggatcgcagaaaaggggaacggcaaggaagacaggttggtctggaggaagggctggaaaaagggctggaaaaaggtcagcgcgttgccgcattgcgtatcgccaaacagatgctggcggacggacttgaccgcgagactgtccagcggttcaccggccttacggctgaagagcttcaggatgttagccactaacgcggttccagtctgaatgttgcaggcccggtgcccgccgggcaacgctctctataattatcgctgataacctcacgaatataccgaactttaccgatagcgccagccatctctactacccttattgttctgagcggcatttacggctgccttaatgacgataacaaggagacatgtgatatggcttaccagacagtgaatcctgccaataatcagctcattaaagagtaccccccgcacacggacgcggatattgaagccgcgctgcaaaaagctgacgcgctctatcactccgattggtccaaaggagagattgaccaacgtctgccggtactgcataagctggctgacttgatcgacagccgtgttgaagaactggcaaaaatcgccagccaggagatgggcaagctcatcgagcagagccgtggcgaagtcaaactgtgtgcgcagatcgctcgctattatgcggataaagcgaagcagtttcttgccccggtgccttataaaaccgagtttggcgacgcgtgggtagaacatcatccgattggcgtcatcatggctgttgagccgtggaacttcccgtactatcagttgatgcgtgtgctggcgccgaacctggccgcaggtaacccggtgctggcgaaacatgccagcatcgtaccgcactgcgccgagacgtttgcccatctggtgcgtgaagccggcgcgccggaaggcgcatggaccaacctgtttatttcctccgatcaggtggcgaacatcatcgccgacccgcgcgtgcagggcgcggcgctcaccggatctgaaaaagcggggagcgccgtggcggcacaggcggcgaagcacattaaaaaatcgacgctggaactgggcgggaacgatgtgttcgtcgtgctggacgatgccgatcttgagaaagcggtgaaaattggcgtgcaggcacggctcactaatgcggggcaggtatgtacggcggcgaagcgctttatcctgcatgagaaaatcgccgatcaattcctcagccagttcaccgaggcgttcaggaaggtgaaggtgggggatcagatggacgcttctaccgaactggggccgctgtcgtcgaaagatgcgctggaaacattgaccagacaggtcgaggaagcggtgaaaaatggcgcgacgctgcacgttggtggcaagccgctggaaagcaaaggcaacttctttgagccgaccattctgacccatattacgcgtgacaacccggcgtactttgaagagttcttcggcccggtggcgcagatgtatgtggtgaaagacgatgacgaggcggtaaaactcgccaacgattcccactacggcctgggcggtgcggtgtttagtcagaatatcgaacgcgctaaacgcatggcctcccggattgaaaccgggatggtttatatcaactggctgaccgacaccgcagcggagctgccgttcggcggcgttaagcgttcgggcttcggacgcgagctatcggatctggggattaaggagtttgtgaaccagaagctggtagtggtgcgccgctaatccctgttgcccctctgaaatcgggaggggcctggctttttgcagcgaaggacgcggatcttaaatcagaacgaaataagcgaacaaaaccccctcaattgccctccttatttatccacgttgcactaaccgtgctttttatcccggtattgtttgtacagacattcatgatgcccgcattttctgttctatgcggaggccggtatggaattttacgagaaccgccccagacaaccattcattggctttgtgcagctcagacgggcgctaaaaaggtggtggctgcgtaagcgggcctgtcaggcgctgcgacgaatgagtgacgagcagttaagggatatcgggttggaaaggaaggatgtggaatagtgaatctattcaagggcaatagtaattaaaggattttatgatatattactatgcccttatgttatgcgtgctcactattttatatcatttatattaatatcattaatctttttctcaatgtatttttctggttttattttggttttttgctcaatcgcatgatatttttccttatcaatggttatagtcattttttcttttttgttaaatatgccagggatgataatcgctgctgcaattatcaataatattattattgctgcatgaattttgtgtttgggaaatgcttttaatagagtacacaggattgttatacccttatgtataagataaggaaaagatagaaataaaacaaatgggcaagcaaaatttatgacatgtttcccatagtaattattatttattgttagcgaatcaatacagaatgccatcacacaaaatagaaatattccgaagcataagaaggatataatgaaagaaccttgcataattcttttatgcaactcttgcaaaatactatttgtgatcttttccagtttagtgttatgacaaataactaccaacatcgcaaaaaaaatctcagataaagcaagcgaaaataacgtattgaaggccatgtagctcatcagcgtttcgaaaaatatactttgctgaagatagtatggtaatagagcgttgacctccataaaaaaagtacatagaaatccaagggcgacataagcaattaaaccttcatttctccaaagcgtaatgttttcttttacttttagccgcatgattttccttcactcattgatatgaattataattaaagctggcaagggttctttgccagcttattttatgcgtttacttagaacctgccatcacgtcgataaacgcctgcacctgcttttgcttacgcgccgatagcttgctcacctggcgcagcgactgcatcaactcgctttcttctggttgcggctgctgtgccgtcagcacaatacagccgttcatcaccctcacatccacctcggtaccggtggcgaaaccggcggcttccagccactggcccttcatggtgagggcgggaatgcgggtataatccggataacgactcgcataactcacggtaaggtgacggttatttgttggggagacttctggatcgcacggatctgcaatagaatggacggtagtcatgatggctattccctaaaatagtgattgtgatgagcgatatggccgtgttcccgcacggccatatcgcgctaaatacctgtacataacatcagtaaataaaagaaaagtccagctgaaaatagactgtaatgggaatgttcaggaataaactggatatatttttgatggttatgattgcggggaaataataaaaagcgcaccgggaaggtgcgcttgaaaataaaggtcaggcttttttacgcgaggtttttttaccgccgctggcggcgcgttcggccttaattttttccagcagggcggcggcgctgttttcaccgctgataagttcagggttttccgcacgccactgggcggtcagctcgccgcggaaggccttcgccaggatcgactgggtgaggctgttgacgcgggtcagggcgttgttgacctgcttttcaatggtgtcggcgtaggcgaagagttgttcgacgcggcggacgatttcgtgttgttcttggagtggtggtagtatcaatgggagtgattttatccttgccaaagccaacttcccttgagctcctgattttatttctgaattgataatatcctgaagataactacttctcagccataaagaaagaaatctattgaaaatattttcgtttaaattacatatcttggcagcattttcagttaaatttgcattattataaacatctggaattataccagcatcaccaatacatgcaccaacaatagttatataaagatctccagatgagactgtatatctagaaatacttttttgtatatattcttctaagtatagttgtccttcaggaagaacagttccattttttagctgccctgctctaatatatggaaaccctgtattctcagctattaatgattcacctttaggtaatctcttgccacctttgacatcagcaaattgaccaatctcactgattttccataaagatggaatagaaatattcaattctgttaacttgaatttattttttttatgaagttcttttgtcagttgcccgtttactgctgcaactatcactgattggcgaaaacgtttcaggatttgtgggatttgctcaagacgtgctttggtgctgtctacctgcgccagcagcgtatcgagtttttcggcgatgactttttgttcggcaagaggtgggacaggaacaccatagttctcaagaaattctttagtaacacgtttatgtccgactgaaccggacatattaagtgctccattagttaaaaaatctttagttttaactaaagcaaacaaccaatggggattaattaacccattaatagaccgaagaacataatattcagtgctaccggcaccatagccgttagggaattctttgattacaacagcttttccattttcgaagcatggcgtgattttggcaaaaataacatcatcgttctgaaattgagtaaatcctttttttacttcactccactttttggtttcaaagttacatttacctaaataggttgttggaacaccggccatcggcataaatccaacatctaaatcatcatcaagtttaagtttgggattgaggttgcacatttcattgattgtgcttgtagcccacccctccggcaatttccccccactcatgccttcacctcgccaaacgcttcattcagcaactgacgctgagcatccgcttcatcgcccgcgcccagctcgcgcatcagcgcatccagttcgcccagcgcctgtaccagctcgcccatcgcttctgccgccagcacgtccggctccggcagactgtcggcgtcgatgctgtctttatccttcagccaggagatatccagcgaatcggattttgcgctgcggatccactcgcggctgaacttgcgccagcggctggtggcctggtgctggtcagtgttcttgttctcttcgctgtcggcgacttcgctctcttcggcgttaaagctccactccccttcttcacgcggacttaagccgtgtggatcttcgccgtagacagtttcaaacggctgcagatgctgctcggtaaacggcgtgcgcttgccgaagctcggcatattggtccgcaggtcatacacccacacgtcatcggtgcagtttttatcctgatgcggattggtgaccgtgcctttggtaaagaacagcacgttggttttgacgccctgggcgtaaaagataccggtcggcagacgcaggatggtgtgcagatggcatttgtccatcaggtcgcgacgaatatcggtgcccttaccgccttcaaacagcacgttatccggcaccaccaccgccgcgcggccgccggggtgcagggtttcaataatatgctgcataaagcacagctgtttgttgctggtcgggtgcacgaaggtacgggtaatgttggtgcccgcggcgctgccaaacggcgggttggtggcgacgatatgtgccttcggcaggttttcaccgtcgctgcccagcgtgttgcccagacggatagcgccgccgtggtcgaggttgccttcaatatcgtgcagcagacagttcatcagcgccagacggcgggtgccgggcaccagttcgaggccgataaacgcgcggtggatctggaaatcctgagtgtcgccatcaaggtcatccagatcgttagtctgtgatttcacgtaacggtcagcttcaatcaaaaagcccgccgtacccgccgccgggtcctgcaccacttcacgcggctgcggtttcagcagatggataatggttttgatcagcgggcgtggggtgaagtactggcccgcgccagatttggtttcgttggcgttcttctgcagcagcccttcgtacatatcgccgaagtcgtcgcgggatttcccgtggttgccattgtaccagtccagcgcatccatatagctgaccagctcagtcagctgtttgggttgctcaatggtggtgctgacattatggaataccgcctgcaccagctttttctcatctgagcctaactgaaccagcaggttgcggtagaactgcatctgatcctggccaatacgcgatttcaggtcatcccagcggtagccttccggcaggtagtccgcttcctggccggtctctttgcacattttcaaaaacagcagcgaggcgagttcattgacgtagttttgataggagacgccgccgtcacgcaggttgtcgcacagtttccacagcttggcgaccagatcgttattgttcattgaagatcctatttgacatggcgaccaccattgtgggtcgcaaaagtgattgagcgtttcagatgcctgatggcgcttcgcttatcaggcctacagggttaggtgtaggccggataaggcatcgccgccatccggcgaaaacggggatgataccctcttaagccagttcgtcccagatgtaatcgctgaacttatccagcacgctgtcgaggttgtcatcaaaggtgcgctgtaacattggcttaccgcctcgacggtggaaattgccggttttgaagacgtcgtcgtcgagcaccactttctctttcagcgcctgcgctaaacggtcgagccagtttatctgctcgtcgctccagtcgttctcggccttgatacgcgccagcgcgtgatcgacacgctcgtcaaacggtttgagcgcatcgcccaccgccgcgcggcggatatggccgatcaggcgggcggcaatatcttcgttgcgcgtcgctttccacgcgctgcgcagggacgactcttcaaaatgctggcggtcaaaccactcctgcaattccaccagccctttacgggtgaggtcacgcgggcgattgatcaccgcctgcaacgcgggctgggcgttcggggcgtgctgcaccagcgcatcgaacgcttcgaggaaatcctgcggtgtgtcgtagtcgccgtacagcgatttgacgcttaccacctcatcgtcaatatcgaggaaaatgggggcctcacgcagggcgttgatatcggttgtcagcctttcgagacgggcgataaagccgggaagcttattgaaaatctcggcgctccagtgcggccctttttcccgcaggcgcgaagccagaccaccaaagttaacgcccgcggcatccaggcacagttcgtccagacggcggacctgcttatctaccgcttcgctgcgatcgcggttatagatggcaagaccgataatccgctgcagcttagcgaccagctgttcatggctgtgttcggcaaaactgcggccatccgcttcgatggttttgtaggtttctgagtcggtaatttcgttgaccagcgtttgcagctccacctgcggacgcacaaccaccgggcgcatggtatcgacgctttccagcgagctgtagatatccacgcagtcgaaaatcttaaagctggttttccctactgacggacacagacgcgtggcgcggcccttcatctgctcgtagagaatgcggcttttgactttgcgcaggaacacaatattacagatagacgggatatccacgccggtggtcagcaggtcgacggtgactacgatattgggcagccgctctttgttaaagcggacgatcatgctttgcactttcttcgcgtctttatcggcatcaccggtgatcttgatgatcgcgtcgtgctcaagctgcggatactttttcttaaacgcgctacgcagctcgtcaaccaccatatcggcatgggcgttggtgacgcagaacaccagcgttttttgctgcccggtgggatccaggtatttggtgagctcgccgcataccgcgcggttaaacgccgggatcaccaggccacggttaaaatcggcgacctcaaaatcctgatcgtcggccagcgtgtcgttgatcagctcgccctgtgggttcaggcgttccacctgttcaccctcggaaagatagaccccgtcctgtgcgttgcgggtgacgatctgaatagggggatcctgatcgatcaggtaaccgtcgattaccgccgtacggtaggtgtagcggtaaaccggctcgccgaaaatatccaccgtgtgcagcgctggcgtggcggtcagggcgatttttaccgcgtcgaaatgatcgagaatgcgacggtaggcggaaacgtaatccagctggctacggaactgcagctcgccttcggtctgctctttatcgagaatgtagccacggtgcgcttcatcgaccacgatacagtcgtagcggccaaccggcatcggttcatcggattgcagcgtgcgcttgaccagtgactgcaccgtggcgacgtgaattttggtgctgtcttccgggaatttgtcggttaaccctttgatatcaaaaatgctgttaaaggtgtcgccgttaatgcgcgtgtcttcaaacgcccccagcgcctgttcgccgagcgagcgacggtcaaccaggaacagcacgcgtttgaaacgctgcgactggatcaggcggaacattaaagcaatggcggtacgggttttaccggtaccggtcgccattgccagcaggatgtgttgctgaccgtttacgatagcctgttccaccgcgcggacggcatcttcctggtaatagcgcaggccgagttcgctcattccgggattttcggcaaaccactgattttgtttctgcggatcgctgcccagcatatccagcagctcttccgggcgatgccattccggcagcgctttcgacatgttggtggtgtggcggacgtcgcgataccagataccgctcttggtcttcatcgccgcgcggtattcgcgcccgttggtggagtagcagaaggggattttaaagcgctgtttaccgctggtgtcctgccagctgatttcatactccggcacggcgtcatgcacttcgtcgggagcgtagtgctccagcagcgtgtcgcgtaaaaatccgttatcgaagtatttactgtagcggtaagactcgttgagcttgctggagacatcggtatttttgcgtttcgcttcaacgacggcgatgggcttcaggccaatgaacaatacgtaatcggcaaagcctgtttttcccgtttcatctgtacctgttggccattcggcaatcgctttattgacgccgggttccgggcgagcgcctttggcaaagcgtaacgttttgctatctgcctgccagcccgctttacgcaactgggcgtcgatcaggaagcgactctcttcttcattgagttccaacgtgcgtttgacagcctggtcggtgatttctttatgataggccttacgttcctgttcggtttgcttcgccagttcggcatcttttgctgcaagctgtgcctccagcgcggccagacgcgctttggtctgggcttcggtttcctgctgtttgccctcaaggatggcaatgtagccgttgagcgcaaccagtctttgctgctgagcttccagttcggcctggctttgtactttctcttgcgcctgacgttccagctgttgtttcagcgtcagcacttcctggtgataaagattctcgccgtgttctggcagaacaaacatcggcaccgggaaatcgtaatctttggtcaccagccggtagtaccagacgctgaggcggaacccgagccgcaggcacatctgggcatcgtccagatcgttatgaaattcgtggacggccaggttaccgatacggcgcagcttatggaaaacagaaaggatgctgtcatcaataaacgcaatcttgcccagttcgcgcagcaggtcatgctggttttcgcaggccggtatatccagcaactggccgagatgtttcgcggtggcttcgccaaacatgcgcatttttatcagagtggtattaggatcgtccggatagttgttttccgccgcgcaggcgatggcgtaaatgaagtcgttgacgcctttgagaaagtcgaagttagatttgttcatttttatctatccggttcctgagcgggaagacgttattaccctgtgccgtaaagggaaaataacagacccatggtagacttcatattgtgtgtgatcaacgaacaatcagagagtaactgcttctttcctaatgttttcctgaagagtatcgttctccggcggggtatctaatctatatcaatagcagggatggatttatggctgttccaacatatgacaaatttattgaaccagtgttgcgttttctggccactcgacccgagggcgctttggtcagagaagtgcgtgaagctgcagccgaaatgcttgggttagatgagcagcagcgtgcagaggtgattaccagtggacaactgacgtaccagaaccgcaccggttgggcgcacgatcgtctcaaacgcgccgggttatcgcagagcctatcccggggaaaatggtgtttaacaccagcgggaatgagctgggttgcctcgcatccgcagccgatgaccgagctggaagtgagtcattttgcttgtgattttaacggcgtaaagctcagtaagctggcagatgcggtggcgttagatccacagccagaatcgattgaggatgatgagcttgccagaagcagcccggacgatcgcctggagcaagcgctcaatgagattcgtgaatctgttgccgaagaattgctggagaacctgcttcaggtttcgccggcgcgttttgaagtgattgtgttagatgtgttgcaccgcctgggatatggcggccatcgcggtgatttgcagcgcgtagggggaaccggcgatggcggcattgacggtattatctctctcgataagctcgggctggaaaaagtctacgttcaggccaaacgctggaaaggcaccgtcgggagcgctgaagtcaggggcttttatggcgcattgcctgagcaaaaagtgaaacgtggcgtctttattaccacctcaggttttacggcgcatgccagagactatgctaacaaagttgaaggtctggtgctggtggatggcgacaggctggtgcatctgatgattgataatgatattggcgtatcctcacgtttactcaagttgccaaagctcgatatggattactttgagtagtggtaacgctggaacctgattgcgggtaattgagatggaccacgttgtgggcacctgtgtttcctctcgcccagaaatcacgtgactttctatggctgcgtatcagcctaaacccatgccggatagcggctgcgccttctgcggcctactcttctggtcaatttccttttatctcgaatacacaaattgtgaagctatttccaacaatccaggtataatcgtaagataattgtatatacatttttgtatgtacaattagggaaaacacatgccgatggagtttgaatgggatgcgaacaaggctaaaagcaacctgaggaagcacggtgtccgttttgaggatgcggtactggtgtttgacgatccccgacacctgtcacgtcaggagcgttatgagaatggagaatatcgttggcagaccctcggccttgttcatggcattgtggtcattctggttgctcatagcgttcggttcgaaagtggttttgaagttatccgtatcatcagcgcccgcaaggcagacagaaaagagaggaatcgttatgagcatggttaaacataaacgcggcaacgcatccgcgctgagtgctcagcatgaggctgaactgaaggcgctggcgaaaaaatcagatgatgagattgattacagcgacattcccgcttcggaggatgggcagtggtctgaagcagtgcgtggtaagttttttcgcccgttaaaaactcaggcctcggtgcgtattgacgccgatgtgatggagtggctgaaacggccaggaaaaggctaccagacgcggctcaatgccattctgcgcgaggcgatgctgcgcgagcaaaataagaaatagcccgaagatgccggatggcggctgcgccttatccggcctacaaattcccgccaggccagataagcgcttaatggttacttccttaaccccacaaatgccgctctgatctcgtcttccggcaactggatcccgataaataccagcgtgctgtgcggcgtttcgtcgccccacggtctgtcccagtcggcgctgtagaggcgctgcacgccctggaacagcaggcggttgggttcgccgtcgatccacagcatccctttgtaacgcagcagtttatccgctgattccagcagcaggttttccatcacccgcgacacctcgctgatatccaccgggtaatccagttccaccacaattgacgatacatcgttctgtttatcggcaataaagtggaaacgcggttggcttgccagcacgttctcttccagcataaagccgctggtattaaacaactgactcaggtcaatatcgccgtgtaccacggtgtaaaccggggcgcgggcgttgatacgcgccagccgctcgcgcagtttctcgctgtcgcctgccacgtcggttttggtcaacagaatgcggtcggcgtagcctatctgcgactgggctatggtgaactgattcatctgctcgttagcgtgcaccgcgtcgaccagcgcaatcacgccgtctaacaggtagcgttcgcataatacgtcatgggagaaaaaggtctgaataatcgggccggggtcagccatgccggtgcattcaatcaccaggcggtcgaaagcaatatcgccgcggtcgcggctgtcgagcaggtctaatagcgcatcttccagctcgttggagcgggtacagcagatgcagccgttagtcagggttttgatctgtgtggcgcgatcgccaatcagttgatcgtcaacggagacttcgccaaattcgttttcgataacggcgattttaaaaccatgttgttcgttgaggatatggcgtagtagggtggttttgccggcaccaagaaaaccggtaagtagggtaactgcaatcggggtcatagtctctccattaacaacagcgcataccgcctttgccatcgccgccgtaacgtgcttgctgacgttcgcggaagaactcttcataggtcatgtacggcttgtcgggatggttggttttcatgtgctcgacatagttgtcgtagtccggaataccaatcaacatttttgccgcctggccgagatatttttttgcctgacctaaagtatcaaacattctgccgtcctgttaatgaataaagccggatggcggcttgcgccttatccggcctacactagccggggtcgctgtgcgctacccggcatcagttttagtggtgtgaagagatcttcacgccgccttccggcacaggcacatacggggtttctttgtcggtacgtttatcgctgttgcgtaccttcatccaggtggtgaaaccgtagaagataatactgtacaccaccaccaggaacagaatactcaaaccagcgttagtgtagttgttcaccacgatatggttcatgttggcaatctgctgctcggtcaggttggcgccgttggcaatcttctctttatacaggtttgccatgtagaagaaaccttccatctgtgggttggcgctgaacagtttcaggcccagcgcccaggtggtgcagatcagcagccataccgccggaattaccgtcacccagatgtatttggtgcgctgcattttgatcagtaccacggtgctcaacaccagcgccacggcggccagcatctggttagagataccgaacaacggccacaggctcttcacgccgcccagcgggtcgaccacgccctgatacagcagatagccccacaaaccgacgcagcctgcggtaccgatgatacccgcgaccagagaatcggtttttttcaggaacgggacgaagttacccagcaaatcctgcaacataaagcggccggaacgggtacccgcatccagcgcggtcaggataaacagcgcttcgaacagaataccgaagtgataccagaagcccatatccgccatcggcaggactttgtggaacacatgcgcgatacctactgccagcgttggcgcgccgcctgcgcggttcaatactgacggttcaccgatatctttcgcagtttgcaggatttgttccggggaaatcacaaagccccaggagctgacggtcgccgctgcatgtgcggtaacgtctttcaactgcgccataatcagcggcgcgttctcgccgcccatctcgtgcaggtttggcatggtaatgcccagacctgccggcggggtgttcatcgcgaagtagagacccggttcaatgatcgaggccgccaccagcgccatcaccgcaacaaaggactccatcagcatcgcgccgtagccgataaaacgcgcatcggtctcacaggccagcagtttcggcgtggtgccggaggagatgagcgcgtggaagccagagacggcgccacaggcgatggtgatgaacaggaacgggaacagagcgcctttccacagcgggccggtaccgtcgacatactgcgtcaatgccggcatttttagttccgggttgaggatcacaatccccagcgccagaccgacgatcacgccgattttcaggaaggtagcgagatagtcgcgcggggcaaggatcagccataccggcagcagcgcggaaacaaaggcgtagccgatcagcgcgaaggtaatggtggtgtctttaaaggtcagcgccgggccccagtaagggtcgtgggcaatcacgccgccgaagtaaatagacgccaccagcagcacgataccaataacggagacttcgcctacgcgtcccggacgcaggaagcgcatgtagatgcccataaacagcgcaatcggcaccgtggagcagacggtgaagacgccccacgggctttcggccagcgctttaaccacgattaatgccagcaccgcgaggatgatgatcatgattaagaagcagccgaacagcgcgatggtgcctggaacggtacccatctcttctttgatcatctcgccaagagaggcgccgttacggcgggaagagatgaacagcaccataaagtcctgcactgcgcccgcgagcaccacgcccgccagtaaccacagtgtccccggcagatagcccatctgcgcggccaataccggcccgaccagcggacctgcgccagcgatggcggcgaagtggtgaccaaacagcacgtagcggttagtcggcacgtagttcaggccgtcgttattgataaccgccggcgtcgcgcgcgtcgggtcgagtttcatgaccttctgggcgatgtacaggctgtagtagcggtaagccaccagatagacggaaacggaagcgaccacgatccacagggcgctcacgtgttcaccccgacgtagggcaacgaccgagaggcagaaagcaccgatgattccgagaatcacccagggtatgtgcttgaatatctttttcgtatccatagtaaaacctggttgtaagtttaattatcagccgaagctgggtggacattgagttcgtgtttgaggaggtagattgactgctatgctgagaggatcttgccagatcatcgcgcgcgtaaagttaggtaaatcagtgagtggttgtatggcggtttaagcggtcggacgtaccggtaagcggtttcgcggaggagggcgtgggctattttatgtgattgagatcacgatataaaatgggacgatccttgttgcgcggggcgtcataacgacttcactgagctaatcgtgatattaatggcgcgcatcccataaagttttccctttccaggccgaaaattctgtatctgtctagcggaaagagaaaacatgttaaagcgaattaaaattgttaccagcttactgctggtattggcgctatttggccttttacaactgacatccggcgggctgttcttcaactcgctgaagaatgacaaagaaaacttcaccgtattgcaaactattcgtcagcagcagtctgccctgaatgcaacctgggtggagctgttgcaaacgcgtaataccctgaatcgcgcgggtatccgctggatgatggaccagagcaatattggcagcggcgcaactgtcgctgaactgatgcagggggcgaccaatacgctgaagctgaccgaaaaaaactgggagcagtatgaggcgttaccgcgcgatccacgtcagagtgaagcggctttccttgagatcaaacgaacctatgatatctaccacggcgcgttggcggagcttattcagcttcttggcgcgggtaagattaacgagttttttgatcaaccgactcaaagctatcaggacgcttttgagaagcagtacatggcctatatgcagcaaaacgatcgtctgtacgatattgctgttgaggataacaacagttcctacaaccaggcgatgtgggtactggtcagtgtgctgattgccgttctggtggtcattatcgccgtctggttcggcatcaaactgtcgcttatcgccccgatgaatcgtctgattgaaagcattcgtcatatcgccagcggcgatctggtgaagcgtatcgacgtggaaggctccaacgaaatggggcagttggctgaaaacctgcgtcatatgcaaagtgaactgatgcgtaccgtgggcgatgtacgtaacggcgcgaatgcgatctatagcggcgccagcgagattgcgatgggcaacaacgatctctcttcccgtactgagcagcaggcagcgtctctggaagagaccgccgccagtatggaacaactgaccgccaccgtgaaacagaacgccgaaaacgcccgtcaggccagtcacctggcgctgagtgcgtcagagacagcgcaaaaaggcggcaaagtggtggataacgtcgtacaaacaatgcgcgatatcgcctccagttcgcagaaaatcgccgatattatcagcgtaatcgacggtattgctttccagaccaatattctggcgctgaatgcggcggtagaagcggcgcgcgcaggcgagcagggacgcgggttcgcagtggtggccggtgaagtccgtaatctggcccagcgtagcgcgcaggcggcacgggagatcaagagtctgattgaggattccgtgagccgtgttgatgtaggttcgacgctggtcgaaagcgccggtgaaaccatggatgagatcgtcaatgcagtgacccgcgtgaccgatatcatgggcgagattgcctcggcgtctgacgagcaaagccgtggtatcgaccaggtgggcctggcggtagcggagatggatcgcgtaacgcagcagaacgcctcgctggtggaagagtccgccgccgcggctgcggcgctggaagagcaagccagccgtctgacccaggccgtcgcggtgttccgtattcaccagcaacagcagcgtgcgcgtgaagtggctgcggtaaaaaccccggcagccgtgtcgtcaccaaaggccgcagtggccgacggcagcgataattgggaaacattttaagggcgtagtggtgaacagtcggcctacagacgaccgtaggccggatgagatgttcacacttttgcctgatggcgtagcgcttaccaggcctggcagtccgcgcaggccgattttaaaccagcatcaggcgcatggtgcagcgtgattcatacgccaggccgtgcgccgcttcctcctctcttttctgatatcgcgcgctaatccaacgttgagtgaaggtgtgcggtgatccacaaaaaatgaataaagcgagagaacgcacggcaggagagccttgtttcgcggcatcataattgctgatgtgataatcgtgagaggatacgatgcgcaaagatgccctgcttgctttcctgatgaaccaaacggatttttttgatccggaaaatgtcagtgaggtgtttaccgcgcgctatctggcgcagcgttttaatatgcagcgcaataccgccagccattatctgaaccaactggtggcgcagggcgtgctctgcaaaatcaatacccgtcccgtctatttcctgcataagcaggcatttagccaacagttttttaccctttcgcgtaatgaatacgccagcgtcgcggagctgttagcgcacggggaacaggagtgcgcgccggacgatcacttttccctgttgattggccataacgaaagcctgaagcgcccgattgagcaactgaaaaccgcgctgttttatcccgacggcggactgccgctactgatgaccggcgaaagcggcaccgggaaaagttatctggcgcagctcatgcacgaatatgccatcgcccaggcgcttctgtcgccggatgcgccatttatcagttttaattgcgcccagtatgcgagcaatcccgaactgctggcggcgaatctttttggctatgtgaagggcgcgtttaccggcgcgcagagcgacagaccgggcgcgttcgaggcggctgacggcggcatgttatttctggatgaagtccaccggctgagcgccgaagggcaggagaagctctttacctggctcgatcgtggtgaaatttatcgggtaggcgacaccgcgcaggggcatccggtttcggtacgtctggtatttgcgacgaccgaagagatacacagtacctttctgacgacatttttgcgacgcatcccgattcaggtcaacctgccggatctccagcaccgtagccgccaggaaaaagaggcgctgatcttactgtttttctggacggaggcgaaaaaactttcggccacgcttatcctcaaaccgcgtttgttgcagatcctcaatcagtatgtttatcgcggcaacgtcggcgagctgaaaaatgtggtgaagtatgcggtggcgacggcatgggcgaaaaagcctgggcaggaaaccgttaccgtgtcgctgcacgatctgccggatgccatgctgtcggcattgccgtcactgaatgaaccgctggcggacgacacgccggtgagcatctcgcccgacacgaaccttacctggctgctgcgcgcccgcgacgagatgcagggcatgatccatgatacgcagtgtcatgtgctggcgctgtacgagctggtacgtagcgggaaagaggggtgggagacggtacaaaaaagaatgggcgatgaaattgagaccctcttcgatcgcctgatttttaccggcgacgataatgtgcactcacagcggttgctgttaattacaagccaggtgcgggaagagttttatcgtctggagaagcgcttcaatatgcagcttaacggcaactgtatttacgcgcttagccactatttaatccatcgtaccgcactggcgccttctcgtctcaacagcgagcagatccgccaactggacgccttcctcgcccagaaatatccgctgctgtacagcttctgtttacaaattctggagacgctgggccagaagctggatctggagccgagacgcattgatatgctgctgctggcgctttggctgcataaacagggggctaacaaccaaaaacaggtgacgcatgcggtgattctggcgcacggctatgccaccgccagcagtatcgccaacgtcgccaaccggttactgaaaaatacgatttttgaatcgttcgatatgccgctggacgtcacgccggaggcgatagcgcagcaggtgatgcgctatctggaagagcatccgctcgcctccggcctgatgattctggtggatatgggatcgctcaaggccattcatcgtcattttgatcgcgcgctttccacgccggtgacgattatcaacaacgtctcgaccagcatggccctgtatgtaggggagcgtattttacaggggcattttattgaagagatcgctcgcgatatcgcccgggatgtgccggtcgagtatcagctctactggccgaaaagcaacaaaccgcgcgccatactgaccacctgcgcgaccggtatcggtgtggcgacgaatctttgcgcattactgagcgccagtattccgcaggcgctggagattgacgtcgtcgcctgcgattatgcgatgctggcgagcaataaaacccaggagccggtatttatgcgctacgacgtactggcgatagtcggcacgctggacccgcacatcgccagcgtgccgtggatttcgctcgactcgctgatctccggcgaggggaatcactatctgatgcggctgtttggttcgctgaccacgccggagcaggtggcggagatcaacaacctgctgctgaaaaacttctcgctccgacgagtgatcgaatccgtcaccatcctcgacaccagcaaagtcatcaaccacgttgagcagtttctgctgcgctatgagcatctggcgggcgttaccgtctcgaatgaaagaaaggtggcgctctatgtgcatattagttgcctgattgagcgtctgatccgccatgcgggcattactgcctggagtgggcaacagtgtccggaacaggaactgaatcggctacgggaagcgtttagtgtcattgagagtaactacagtgtcaaaatccccaccgccgagcttggctatattcataatatcctgaccttcgaaacagaacttatcgagcaagatcaacagttttaactatttccctctgttaacccgcatcttttttcggcgcgccactttttctggcacgccgcttgctctcttttatcacagtggaatgtgttttagaggtcaggatgaagagacattatattttcgccagccacggcacgctggccagcggagttttaaactccgtggagctgattttaggcaaacggtcaaatgtctggacgctgtgcgcttacgttgaagagagcgtggatttaagccagcaggtagatacgctaattgcccggatcccgccggaagatgaaattattgcgctgaccgatatttttgccggcagcgtgaataacgaatttgtccgttatttatcacgggaaaattttcatctgctggcagggattaacctgccgctggttatcgatctctttatgtcggaaaacgatggcaataccacgcataccataatgacggcgttagcggattcaaaagaaaatattcagtactgcaatcaaactatcaccagcgccatgcaaagcgataaagatttttaaggggaggaagcgtcatgattgtttttttacgggtggatcatcgtttattacatggacaggtcgccttttcctggacgcagtacgttggcgcagactgtattttaattgccaacgacagcgtacctaatgatgacctgcgtaaaaccaccattaagatggcgaagccgcccgcggtgaagctggttattaaaaatattgccgattcaattgaagcgataaaaagcggcgttaccgataaatataaactttttattgttgttgaatccgtggcggatgcgtaccggctggcgcgcgaattacccgacattaaaagtattaatttaggcggcacgaaggtacgtgaagggagccagaatattgctaaagccatcaatctgttagcggatgaaatgactcaacttcgggagctggcggctggcggagtagagatagaaattcggctggtgcctaacgatcgtaaacaactttttgcctgagcggataccctcctgaggacatattatggtagaggcgcttttacttggactggtggcgtttatcgcccagtctgaatatgcattagggacgtcgctgatttccagacctatcgtgaccggacttttaaccggactggtgctgggcgacatggaaaccggaattgtgatgggcgcgacgctggagttggcgtttatcggttccttttcggtgggcgcgtcgctgcccccggatgtggtcactggcggtattttaggtgtggcctttgcgattaattccggcgctggggcggaaaccgcgctgttattaggtttgcctatcgcgacactggcgttaattgtgaaaaatatctataacggaatgtttattccgttgctctgtcataaagccgatgcttacgctgaggtgggggatacccggggcattgagcgtatgcatttaatctccggcattgggctgtcgctgatgctggggattatcgtcacggtctcttatttagcgggcgtgaatatggttaaaggttttctggatgccattccagaatttattaaacatggattaagcgttgccaccggtattattcccgcgctgggttttgccatgctggcgcgcttattaattaataaaaaggtcgccccctattttttcctcggttttgttttaatggcgtatttaaaaattccggtgacgggtattgcgattctcggcgcgatcgtcgccgtcgtgatggtcaatatgccgaaatttgcggcctcgcaaccggcacctgcgcaaggagcgtctcatgacgatgaagatgatttctgataaagaccgccagcaggcggaaaccactggtctggtcaccgcgcgtgatttacgccgcgtcttctggcggtcattccagatggagttttcctggaactatgaacgacaaatgaacctggcgttcgtctatacgctcattccggtattaaagaaactgtatagccgaaaagaagatcttgccgaagcgctaaaacgccatctggctttctttaataccacgccgcacattgtgacgttgatcctcggtattaccgtggcgatggaggagaaaaatagccagcagaaagagatggacgccagttctatcgataacgtcaaagcgtcgttaatggggccgctggcgggtattggcgactcttttttctggggaacattgcgtcttatcgccactggcatcggtaccagtctggcgctgaaaggcaatattctggggccgattttatttctgctggtgtttaacgtaccgcatattctggcccgctggttctttacccgctggggctatgtgctgggaaccggcgtactgcaacgcattcagcaaagcggaatgatggaaagcctaacctatggcgcctcgattatcggtctgatggtggttggcgcgatgacggcctccatgattgatatcaccattcccattacgtttggtacgggagaagcgaaaacccatgttcaggacattattaacgacatcatgccttgtctgctgccgttaattagcttcgccattgtgtactggctgttagggaaaaaagtgaaaccgttaaccatcattggcggtattgcgctggtgggaattttcggttcctggatagggttattttaagagggatacacaatgtcaccaaccatgctgacctatattaacgaagagtctgacgtcctggcgaatattattcgccgccatcgccagtctctggaagaagtatcgcggttcgccagccaaaaaacgttacgacgaatcctgatattagccaccggatcgtcattgaatgccgccttttgcgcccgttatttctttgagcgctgcggtatctctatcgatattaaagagccgtacacctttagccagtatgagaatagcgatccgcaagccgatatggttattgctatttcccagagcgggaaaagcgcttctaccctggaggcgatgcgtaaagttcaggcgcagggacgtccggtattcgctctgaccgccgatccgcaaagccctcttggcaaggccagtgattatccactggatattctgaccgggattgagtccgtcggctttgttacccgtggatttagcgcgacggtattgaatctgttgcttatcgcgttgttaattgcccgtcagcagcagcgactgacggaatcgcaggtcgaggagtatgtggcgcagcttcaacgtatcgcggcaaccctgccgttggttatcgtgcgtacggaagcgtttattcaccagcaccaggccgttttacgaaacgggacgcgttttgtggcgacaggctacggcgcgctggttggggtggcaaaagagttggaaactaaatttaccgagacggtgcgtgttccctcaagcgggtttgagctggaagcctatatgcacggcccgtatctggaagccaatgcggaacacgtgatgttcttctttgaggaccggcccgacgcgcgctccagggcgctacgggagtatatgacgcctgcggtcgccaaaacctttactctcacgctggcgaaggcggcgcaggatgaccagacgcttgcgctggatgtagcggttgatcaccatttctcgccattactgttgattgtgccggtacaactcatggcgtttcatatcgcctcactgaaaggcatcgacctttcggtacgcatttttgacgatttcgatcgcgttttaaaaagtaaaatctgaacaatcaggagaaaaatatgttgggttttaatcaggacgagtacctgacgagtgctcgtgagatcatcgctgcgcgccagaaggcagaacaggttgctgacgagatttatcaggccgggttcagttctttatttttcgcctctgttggcggttcactggcgccaatgatggcaattaatgaatttgccaaagaattaacaacgttgccggtttatgttgagcaggcggcagaattaattcataaaggaaataagcggctgaataaagactctgtggttattacgctgtctaaatccggcgataccaaagaatcggtggcgatcgccgagtggtgtaaagcgcagggaatacgcgtagtcgctattaccaaaaatgcggactctccgctggcgcaggcggcgacatggcatattccgatgcgtcacaaaaatggcgtggaatatgaatatatgctgctgtactggctgtttttccgcgtgctgtcgcgcaataacgaattcgccagttacgatcgcttcgccagccaactggaaattctgccggcgaatctgctgaaagcgaaacaaaaatttgatccgcaggcggacgctatcgccagccgttatcataacagcgattatatgatgtgggtcggcggcgcggagatgtggggcgaggtctatctgttctccatgtgtatcctggaagagatgcagtggaagcgcacgcgccccgtcagctctgcggaatttttccacggcgctctggagctgctggaaaaagacgttccgctcattctggtgaaaggggaagggaaatgccgcgcgctggatgaacgcgttgagcgttttgccagtaaaattaccgataacctggtggtgattgatccgaaagcgtatgcgctggacggtattgatgatgagttccgctggatcatggcgccgtgtgttgtttcgacattgttagttgaccgactggcggcgcactttgagaaatataccggccacagtctggatattcgtcgttactaccgtcagttcgattattaacagaaaggggcgtgtagcatatacagtgcctgatggcgcttcgcttatcaggcctgtgcgccagtttatggataaagatgatgtgtaggccgggtaaggcgcagccgccacccggcatatatgacattctcttttaactttcaacattcaccactttgatctccaccatgccaatccccaatttgcgcggcgaatggcccaaaatattaccttcgttggtggagacgggagcgggcggcgcaatgactaaggtattcgcgtccgtcgggttgttgaaatgcagcgtgatagtggacacatcgtgacccagcaccagcgtctgttcttcgttgcctacgcgtaccggaatcggtcgattcgcgttgtcgccgaaggctttggcggtgatcaccagatcaaactttttcggcagcggcgctttatattcgattttaacctcatcgcccaactgcgcatttgaccagcgcccccaggactccggccgggaaatgccgctaaactgcttcacctcctccggggcgcccgccacgttaaagataaagctatcggctttataacgaatatcgttatcgacaatctttaaggtatcgacgttgcctttgtagcgctccatatcgatcatcgtgtctttaaacgccgtcttaccctgccactgcgctttatcaacatgctgtacggtttgctgcccgccaagctgcccctgcgagacgcaccagtcggtagagagcgccagcgccggcgcccatagctgcgccattttgtagcagcgatcgatccaaacgaaattatcgcgcggggcgaagtcggccaactggaaccgtagcggagcggagtattcactttccggtaacggctcgacgcgcttatccgatacgcgcagtagtaacggcaggcggaagtggctcccggaaaacgcgatcatgtttttgtcccgatcgacggtaaaatcttttatctctttcgggaaattccacaggcgaatgatatccggcttcatcgccagcactttctcttttacattcaggaacacttccgacagcgactgcccggaaaggctgctacgtcccagaccgataaaattatcgccgccgagaatatccagcaccgttgcgccgttgtccatcgtgttgcgtttgaccgccagagtctcctgctgtggtttatcgccgcgcagaatgaaaaacagattgttgcgatcttgcttattcaggtatttccaggccgtattgttcatcgccagatggtcggaagagacgacgataacggtatctttaaaccacggcgacgctttgattttgttgataaactcggcgatgttttcctggctgcaacttacggcgctaaaggactggttgggcttgccgtcgtaatcgtagcgtttgcggttgcaggtgcgtgagataaacccgtccgggtggtgagtatctacggtcagcgtaaacagcgaaaaacgctggcctgagcgggaaagcgcttcaaatttcttccatgcctcatcaagcaccgtatcgtcgtagaagccccagtcgttacgataagacgggtccgccaccaccgtttttagctcttcagcgccgtacagatgatcaaatccgtgtgatttcaggaacacgtctttcccggcaaaacgcaggttagcgccctgcacgaaatagttctggtagccggagtttttcagaatatcgccgaggcagatattctgcgggaagaagctagaaaccgacgcggacgcattgccctcaaacggcgcaaacagcggaataccgcactgggaagccaccatcccggcgatggtgtaatccgttcccggcagttgcatggtatggctgaaatccagcccctcatttttcagcgcgcccaactctggcgtgagattggggaacgcgtcattatcaaaataggtccgttccaggctctcgccgtagatatagaccagattgagcttcggattaggaatggtttttgctggttctttataataaacggcaaaatccggatcgccatcgcgcatttgtgattttaccagttcggtaatctggcgaaacgccgggctggcgtcgaccgaacctaacgccagcagtaacgccagcaggctgtaaccgacatgatgaggatggtgacggcggcggcgtagtacccatcccagcgcgccgaataccgccactaacgccagggcaatgccgattcccggcagaatatatttgccgactcccgctcccgtcagactattcgtgagcgtataaagcactgcgtcgttgatcccgtcgccggtaaaatagtcgctggcatacagggtaatattcagaatgacaaaaagtcccagcaccgtgagagtggcggcaaaccaccaggtgttacggcccgccttccaggcatatatcagcacagaggcgagaaacagagcgacagagagcaactcggacaactgacgatcctcaataaaccaggcttatcgctggcaggaaaaaatttctaacaatgtaatagcgatgtcacattgctgcaattctaataactttacacggcgctgttatttagaatgagtttagaaagttggttttttgatcggcatcacttcctgccatagcggttaataacaggaaaagacgaagagaaaaatcgggttaatgccgtgttggcgggtaaagggccaaaacacggcgtttatcagggcgtcccggcgtggcgcacggtcagaaaaacgcagtcaggagaggaaattcagcccttgctgcaacaccagatcgcaagctttggttttcaccttttccgccagcggcgtactgccgatattattgaggttcaactgctggccgtccttcgtcttgagcaacccttgcaggccgttcaggtagttagtgtcctgctcctgctgtgtggtatccaaccccaacttgttcagaatctgatttttaacgttttccacgttggtagcggacgccagtttctgtttggcgcagtactgcaaaataccggcggcattattcatattatcggcgctgagcgactgggcacctctgctgagcagaccggttagcgcagaaagcgacatcccgccctgctgtgcgttcgcgccctgagcgcttaactgactggcggcaataccgctggtggaaatcagtacgctggcgatcgccgcgcagcacagaacatgtttcgctgtattcatggtaatcacctgtgttatgccagtcaggcgtcgtatcgccctggcgcacgttgcaatttaatactctttacccgtcacccggctgcggtaactgtcccaggtaaaattaacccataaactgttgccgagacgcatacggtccatgacgcgttcgccaagcattttcgtcatctcttccatattgctgttcgtcaacatgccggtgggacgttttgacgaggaacgacgatcgacaatttgattgatgatcactttttcatagcgggattcggtctgcacgccgatctcgtcgatcaccagcagatcaacgttactcagatcgttaagcaactgctcttcgctggtttcccgattgctgaacgtgtctttcatcgctgacataatatccgctacggtgataatcagtaccgactttccgcgcagcagcagctcgttacaaatagccgcggcgagatggtttttaccggttcccggcttgccggaaaagacaaagctggcgatattgccgtcaaactcatcaacgtactgtcgggctttgcttaacgcgttcatttgtccgtcgcactcaacccgatagttatcaaacgaacagttctgatgcagcggtcgaatgccggaacggttaaaggtgcgctgcattttcatcgcccggttttcccgcgccagcgctgccgcccggatctcgccttgctctttctgccacgccagcaattcttcgcccgttttaaacgccggcgtaatatgcgcaggcatcattttttgtagacgctgcatcaggtcgccaacatttttcatcgttaccccctaaaacctggtggaatatgattgtcaggttcgctgacgctattgatgtcgcgctgcggcattccgccattgctggaacggctgatttgcacgctgcgcgccagcttttgctgccactggatatggtgaaaaaccttaccttccgcctgccagtaggcgataaacgccgccagctcttctgcggtgaccggctcccgaagcgccacgccccaaagggcagcctgacgctgaaaatccgcatccggttgccaggcgggatacatggcgaattttccgcagggaatcgcaacgggggcggcttcgggttcttcgtaaaattgtgcgtctaacgccacatcgcttcccggacgtgataacttttcttcaagcgccagcagttcagccatgcgtgcaggcgtcacggcataaaaggcaggcgcattattagcgaataccgccactgcgccgcccgttgacttcgccagcacagcatgatgatcgtgtaaaaggacgtcaataccgatgacgtccgacgttaaaattctggaagacataatgtttctcaatatggaacaacaaccgagaagggcgactgtttttatagtaccacacagacctgtaagaacagcaggaggcgttccaccaatcacacgcgggggcgtttgcggtacagccataatcccggtacagagaggccaattgagagcgcgccaacaatggaagaggctttcagaaaattggtcagcagcgtaatcatcatcggttcgctatagcccagatggctaatttttactgcggaaatcatcgcggtataggcggaaatccccggaaacatcgggatcacggccgcgacggtaaacactttagggtgagcgagataccagcgtgaccactgaataccaatactgccgaccagcagcgaagccataaacgttgaccattcgatattaaaaccagcgctcatcatcagcatacgcgagccatgacccagcgcccccagtagcgcgcaccacggaagcgcccggtggggaacgttaaagaccatcgcaaacccgacggcggggatcgcagacaagatcatgtcctgcattagcgccagtaaaaagtcgattatacccatcctcgtagcccccatactgtcattgacatcactacgcccacacaggtggccagtgtcaacaggctggcgatagcccagcgcgccagcccggtattaatatgtcctttaaacatatctgcgacggaattaatcagcggaaagcccggcaccagtagcagtacgctcgccgccatggcgatagtgggcgtctggctaaaggcgggaagggtgagcatcagcccggaaatcgtggtagcgacaaaggcggtaatgcaaaaattgatctgcggatgtaaatgccgctgcgccagcatctggcggatatacatggctatcatactggcgaaaaaggtgataaccgcgccatcccagccgccattattcagcttacaaaagcaggagcaggaaagaccgaccataaacgccaccagccagcgcggataacgcagcgggcggagctggctaaagcgtttttccacgcctttgtaatccagcagacgatgttccgcgaggataacgatatgctgaacctccgtgacgacgtgcatattaatgccgcgatcctggtttttacgtgtcgatgtcagacattgtccgtctttaatggtcgtcaggacaatggcgttagaggagatcgcgctttcgacgctatccataccgagcgccaaaccgagtcgggtggaaagctcatcaaccagtgcgctttccgccccgtgctgcaataaaaacagcccgcattgaatacataaccgtgttactgctcgttgaattgattgctcttcttgcatgactcgtcctgtccgaaaagacattctatgcgccgccactatgacagaggcttcctttttaacacgaagcacaggcatgatggcgttggttaagatcaatttcttgttgataaaaacgtcaaccgccagacgcaacgcataagcttcctgagacgtgcgcttcgtcacaggcaggatatccttatgggcgacggttctcgtatgtccgtttccagaatagaggcattatgccagcctggccgctcatttttgaatcaatgatgtggtgaattttatcaacgatatgcattaatggtttaacaacaatggcgtgagtagcgggcgtaaaattaggcatgacttagtataattcgcagatattacatgagttttatggatggtagacagtattgttgggcttttgttttaggactcagcaatatgaatgaagggcgaactcatattttaaatttattaatatgatgcgttttcgttagaattactaatgtgcaaatttagttaatttaattgtcttgcttctggttttatgagtaactatgcgatagtgatttcatgtttttgtgctatgtggattgtagcgcaatcaatgttatatttttaaaaataaaacaaggataattaatccactcggcttatatttctttgcgctcattgttaatagtgtttttattaatggggcaatgaaaagtggcggcgtgggtgcggaggaattatgctgccaggatgctgcaaaaatggacttattatcagtaaaacccctcttatacaggaaggccttaaaggggctataacaggtaatttccccgattataaactggcgtattgtcgtacgatagaagagctaacgctgctacagctacgccgaagtaatttagttattgctgatttagcagttaacaatgcctctccccgcgctatctgcgaatatttttatagcttactctcgcaatatcgcgacatacattgggtatttctggttcctaaatcctgctatccacatgcggttgatctcctgatgggccccgtcagcaccttgctttcagacgaagagccaatcgagaatcttattagcgttatccatgcgggaaacgctcgctcagaaagaataagcaaaacattattatcgcctcaggtaccgtctgaaattcagcagtcccacgacaggccgattgtccttacgctgtctgaacgaaaagtattacgccttttaggaaaagggtggggcattaaccaaattgcggcgttacttaaaaaaagtaataaaacaattagcgcccaaaaaaatagcgccatgcgacgcttatcaatacacagtaatgcagagatgtatgcatggataaacagttctcagggagccagagaattgaacctaccttcggtatatggagaaaccatggaatggaaaacagaatcagcaagagaaatgttgcgctcgtagaaaaatgcgtgatgagcaccattggtattaaagggctatttgatgcaatgccggattgccgacatacgcttcatattttttcaaaaccatccgcgttttataaggctgcgctaacgacgccgttttctgccgttattttttctctttctgcgttaagaactgaacgccggacaggattatccagcctgacggaactggcgataaattatccccatatgcggcgtctggtgattgccgatgatgatgctgaagctcgcttaatcagcgcgctatccccgctgccgctggatggggtcatcagcaaagcgtcgccgttggatgttttacaggatgccttatttacatcgcttaatagcgcccgacggacaacggagcgtacagacaatctttgggagcttcaccagaattgtatgcttagtccaaccgagcgggagattctgcgttttatgtcgaacggctactcaatgccgcaaattgctgtccagttagaacgtaacattaagactatccgagcgcataagtttaatgtgatgtccaagctgggcgtgagttctgatgccgggttactcgatgcggcggatattctgttatatctgcgcgccggcgatgctaccgcgctccagcatcgggtatagcccgcgccggatgcgccgtgcttgttcggggaatcagggtgccaggcacgttattggcacacgtctacccaggtcgccgatgtcagttcagccattctttccggcgtgatgcgtaccgcgctgtgcgtggcgcctgcggcaggcaatacttcgttataccccttcagagagatgtcgcaataaacgggcagcgggtgctccagcccgaaaggacatacgccgccgacaggatgtccggttgcattgaccacttcatcgctgctcaacatacgggcttttgcgccgaaagtggttttaagcttcttattatccaggcgggcatcgcctttcgcgaccaccaggataatggtgtcttttactttaagcgagagcgtcttagctatctgccctggctctacgttgtgcgctttggctgccagttcgacagtcgctgtactttgatttaattcgataatttcaatatcgggagcatgatcggccagaaattgccgtacagattgcagactcattcttctctcctgagaccttaccaatagccacggtagacccaaaaatggcaaaacgtaatttggcatacggagagcgccgctgtaaatataataatgtgacaggccagcagcagtaagccgtgacgataactgaaggcaacgtaaagcggtttactttagcgtgcagtcgccgcactgctgtacgtcaggtaagcggtaacgttggcagcaggttctgcgtaccagaagaccgtcgcgcattacgacggtccgccacagcgggttatcctgaccgtcggatagctgcttttcaaaaaaacagcgctggcgtagcgttgccagcagggcttcgccaagcagcggtttcatctcagtcagataccagttgattaaataaccggtattgctccagataagtttcgcgttgatgtcgccagtcgcctccagcgcctgaatgaccggctgtagtgcggagactattagcgtttccattcgttcttccggggaacgctccgttgccaggttatcctgatgcacatcaagccagaaacacgcggcgcgcccggtttcatgaaattcaacgtgaatatgttctgccgagacattgatagcgcgcgcttgcgtcagtaatgccagcatcagcggcggcgtcatcagcccgatataccattgcgcccatagggagagtaacggcttattttcacgtggcaggcctggcgtgtgccgatagatgtgatcggaataggcggccagcaatgaacgaaacgtcgcggggcgcgtccactgggcaagagtcatcgccgctggcggcggcgtttcatccagccggatgaagtccaacaggtgcttacgggtagaggcgatcgtctcgcgtactgcgtccgccagcgaggcgtcttccggctggggagcagctcgccagataatatcgtcagcaatcggtgcggaacggtaggccatagcgcagtttaatgatgttaatctaaatgataatgattgctaatcctatcgatagcgataaacgatggcaagcggtttatggttaacgctgttggcgtagcacgattacgccaacaggattcatagggcgcgcatgtcgtcgctgaccagaatgtggttacgtccaagatgcttggcttcgtagagcgctttatccgctttttcgatagcgtctccgatattgcgatccgtcaggggcgcaatgccgatactgacagtgacattggtggcgacgctttcgttaaacatatgcgggattttaagatcgtatacttcctgtcggatacgttctgcggtagcgcgggcttgctgtggttcggcggtggtcagcaacaccagaaattcttccccgccaaaacggcagacgacatcgcgcgatcgcacggcgtcccgaattgccgctgagacgcgaattaacgcctgatcgcccatcatatgaccgtagtgatcgttatacgctttgaaatgatcgatatccaatagcaggacgtagtgttcatggctgcccggcgcctgtaacgtatccagccgattttgcaggccacggcggttatataagccggttaatggatcaagcatactcaggccattgagggtttcccgctcggccagcagcttaaacatgagctgttgggcaaaattatcgtagcgtttctggataacatgttgaatagcgattcccaccattggcagggtcagcaaatagagaattcgcaaaccttgttcattaccgttcagccacaggcagaccgcgactggcggtagcgaatagagcgtaaacgcgacgatattcgcggcaaaggctatcgagccgataaacagaacgctaagcagggaaatcagtaaaaaagagaaatcataatggcctaacgccggatactttagcgcaatatgcgccgcccatattcccccaaagagtagggagataaaggggagattaattcttttttgtccatatttcccatgccatatcaacagtaatacgctcaggaccactatcccgatcattggcgtgcaaaatacattgatctgataaagggggaaaacgagagtaaatagcgccgacacggcgttgagaaacaagaaaagacgtaaagaaaactgatacttcttaatacgaagcgaccgccaggatggggttgtcatgggtaattgtcgttatttatcggtgatatacacggaatcgggcgccaacatgaaaataacgtatgagaaaaggtcgcctaaagcgaggtgttgttgtttttacgttaacagtcggacaatttatcaccttactgaatacgtgtcatcaaccgttaagtaaaactcatctctttagctttctccctggctgacaaatgagaaaatatatcatatgatattggttatcattatcaattccagaggtgaaaccatgttgcagcggacgttaggcagcggatggggcgtattattgcctggagtgattatcgttggactggcgtttatcggcctgtcagctgatgcgctgaagctgttgattgtatcaggattgctactgtctgcgctgatgttgtatcacaaacaattacggcattttgtactgctgccatcgtgtatagcgcttattggcggcatgatgttggcaatgatgaactggaatcagggatgaaaatgaagagacaaaggaaggataagataattggtgcgaggggggggacttgaacccccacgtccgtaaggacactaacacctgaagctagcgcgtctaccaattccgccaccttcgcacagttatcttactttttgatatcgcctcgttggtgcgaggggggggacttgaacccccacgtccgtaagaacactaacacctgaagctagcgcgtctaccaattccgccaccttcgcccagtgcgagcaatatcaacgtggttttggtgcgaggggggggacttgaacccccacgtccgtaaggacactaacacctgaagctagcgcgtctaccaattccgccaccttcgcataccatcgattcttgaaaagaatcactaccacggaggcgcattctagtggttttcagctattcgtcaatagttaattgcatgggatagattgattgctgcaaaaatggacgcgagacgtaggttggataagacgctttgcgtcgccatccggcacatgcaaccagatggcgctgcgcttatcaggccaactatttcttcgcctgacgggtcatcacggtacgataaaccttaaagcgcccggtttgcgcgatgacttcatggaagccaaaagtctcatccagaatcttaggatagggcagaaaggcgttcgccacgatgcgtaactctccgccgctgttcagatggcgcactgcgccgcgaatgagcgtttgcgccgcatcgaggctggtttgcattccgtcgtggaacggcgggttggagatgatcatgtcaaaacgtcctttgacttccgaaaagacgttgctggcgaatacctcgccttcaagaccattagcggcaagcgtggcgcggctggcttccaccgccggagcgctgacatcacacagcgtcaggcgcactttcggcgaatggctggccagcgcggcggaaagcacgccagcgccgcagccgacatccagcactttacctttggtgtgcggcgtcagcgtagacagcagcagttggctaccaacatccagtccgtcgcggctgaatacgcccggcaacgttttgatggtcagcccgtcgatgttgtactcggcccaccaggattcaagactaaactgcggctgcttttccagacggccatggtaaaggccgcaacgtcgcgcgctatctactttgttcagcggcgcatagtccgccagcatcggttcggcgctacgcacgccgctgcggttttctcccacgacgaaaacatcgacgcccgacggcatcagcgacaaaatattcatcaactggaactgcgcttcgggtttatttttcggccagtagtagatcagcgtatcgcagtcagcgacatcgctggcttgcgcgaccaggctaaaacggacgttatcgcccatctggcggcttaatacctgccagtggtgaaactgttgcgtatgcgcgcggctggcggcgcattcaaagcgcgcgggcaggtcatcctgcaaatctccggcaaaaagaatacggctttgttcgaaatcatcactgtggcgcagcaagacttcacttgccggggtaaaagcagacatggaatgctccttaattcagactggcggcgattatagtagtttgatggcgcagattcgacagatttgctatatttgcgcccctgattacaggagcgtttcgctatgacatcccgacgagactggcagttacagcaactgggtattacgcagtgggcgctgcgacgtcctggcgcgctacagggcgagattgcgatttcccttcccgcgcacgttcgtctgatcgtggttgcagaggaattacctgcgctgaacgagccgctaatgcgcgatatcttacgcgcgttgaccgtgagtcccgatcaggttttaccgctgacgcctgagcgcgtcgccatgctgccgcagggcagccgttgtaatagctggcggttaggaactgacgcgccgctccaactcgaaggcgctcaggtcacgacgccggcgtttaatgaactccgggcaaacccggcggcacgcgccgcactatggcaacaaatctgcgaacatgaacacgatttctatcctcagcacgaccgatctccccgcagcctggcagattgagcaacgcgctcatgcgtttccgtggagcgaaaaaacgtttttcggcaaccagggcgaacggtatctcaaccttaagctgaccgctgatgacagaatggccgcgtttgccattacacaggtggtgctggacgaagcgacgctgttcaatatcgccgtcgatccggattttcagcgtcgggggctggggcgtatgctgcttgagcatctgattgatgaactggaaacgcgcggtgttgtaacgctatggctggaggtacgcgcctctaacgctgccgccatcgcgctgtatgaaagtctggggtttaacgaggcgacgattcgccgcaattactatcccacggcacaagggcatgaggacgccatcatcatggcgttaccgataagcatgtaataaaagaggcaaggtgtaatgatgaagtgggactggattttctttgatgccgatgaaacgctgtttacgtttgattctttcaccggcttacagcggatgttccttgactatagcgtcacctttaccgctgaggatttccaggattaccaggccgtgaataagccgctatgggtggattatcagaacggcgcgattacctcattacaattgcagcacgcgcgctttcaaagttgggctgaacggctaaacgttgcgccggggctgctgaatgacgcttttattagtgcgatggcggagatctgttctcctttgccgggcgccgtttcgctacttaatgcgattcgcgggcaggctaaaatcggtattattactaatggttttaccgcgctacaacaaactcgtctggagcgcaccgggctgcgcgagtatttcgatctgctggtgatttccgagcaggttggcgtcgcgaagcccgatccgaaaatctttaactacgccctggagcaggcagggaatcctgaccgctcgcgcgtattaatggttggcgataccgcggaatccgatattcttggcggcattaacgccggactgtcgacctgctggcttaacgcgcatcatcgcgagcagcccgcgggtatccatccaacctggactgtggcgtcattaagcgaactggagcagctcctgtgtaaacactgattgcctcccccaggttgatgggtaaaatagccgcatttttcgtattcaacatgcgtggtcaaacgccgcgcttactcaagaagatttgactatgacgttgtctccttatttgcaagaggtggccaaacgccgcacttttgccattatttctcacccggacgccggtaaaaccaccattaccgaaaaagtgttgctgttcggacaggcgattcagaccgccggtacggtaaaaggccgtggctccagccaacatgcaaaatctgactggatggagatggaaaaacagcgtggtatctctatcactacctcggtgatgcagttcccgtatcacgactgtctggtgaatctgctggacaccccggggcacgaagacttctccgaagatacctaccgtaccctgacggcggtggactgttgcctgatggtgatcgacgccgcaaaaggcgttgaagacaggacccgtaagctgatggaagttacccgtctgcgtgatacgccgatcctgacctttatgaacaaactcgaccgtgacatccgcgacccgatggagctgctggatgaagtcgagaacgagctgaaaatcggctgcgcgccgatcacctggccgattggctgcggcaagctgtttaagggcgtttatcacctttataaagatgaaacttatctgtatcagaccggtaagggccacaccattcaggaagtgcgcatcgttaaagggctgaataacccggatctggacgccgccgtcggtgaagacctggcgcaacagctgcgcgacgagctggaactggtgcagggcgcgtctaacgagtttgatgaagagctattcctggcaggggaaattaccccggtatttttcggtaccgcgctgggtaactttggcgttgaccatatgctggatggtttagtggcgtgggcgcccgcgccgatgccgcgtcaaaccgatacccgcacagtggaagcctcggaagagaaattcaccggttttgtctttaaaattcaggccaatatggacccgaaacaccgcgaccgcgtggcgtttatgcgcgtggtttccggtaagtatgagaagggcatgaagctacgccaggtccgtaccggcaaagatgtggtgatttccgacgcgttaacttttatggcgggcgaccgttcgcacgttgaagaagcgtacccgggcgatattttgggtctgcataaccacggcaccattcagatcggcgataccttcactcagggcgagatgatgaagtttaccggtatcccgaactttgcgccggaactgttccgtcgtattcgcctgaaagatccgctcaagcagaagcagctactgaaagggctggtgcagctttctgaagagggggcggtgcaggtattccgtcccatctccaacaacgatctgattgttggcgccgtgggcgttttgcagtttgacgttgttgtcgcgcgcctgaaaagcgaatacaacgttgaggcgatttatgaatccgtcaacgtggcgacggcgcgctgggtggaaagcgccgatgcgaagaaattcgaagagtttaagcgtaagaatgaaacgcagctggcgctggatggcggcgacaaccttacctatatcgcccccacgatggttaacctgaacctgacccaggaacgttaccctgacgttcagttccgtaaaacgcgcgaacactgatccctttccgggcgcggcatccgccgcgccttcgtactttccctgcctttttaaccgcttacggaatgttcttaaatcccgcgttttttctccgatctgcctgttttttatacgcaccgacaagcgattttaaaattgtgatctatatttaacaaagtgatgacataaatgtcggctttaatgcctgttcaatgcgtgaatatgagagcttaaagctgagatttgtttcagtcacgatattaataactgaaacggaagggtggcaggcgacgcgtcgttacaaattcacgaatgtgatgccagtcattgacttcagaaaccggtgagtttcaccgcattcagcaatgcaacctcgtgttgcctgagctcaaattacgagcaaactatacaggacaaaatcgatgactatgacaagactgaagatttctaaaactctgctggccgtaatgttgacctctgctgttgcgacaggttctgcctttgcagaaaacgcaacaacggacaaggcgcaaagcggaaccgaaaccgcagggcaaaaagtcgatagctctatgaataaagtcggtaacttcatggatgacagcgccatcactgcgaaagtaaaagctgcgctggtagaccatgacaatattaaaagcaccgatatttctgtcgaaaccaatcagaaagttgtcaccctgagcggctttgtagaaagccaggcgcaggctgaagccgccgtgaaagtggcgaaaggcgtagaaggcgtgacctccgttagcgacaaacttcacgttcgcgacaataaagaaggttccgtgaaaggttatgccggcgatacggccacgaccagtgaagtcaaagccaagttgctggcggacgatctcgtcccttcccgtaaagtgaaagtggaaacgaccgatggcgtcgtacagctctccggtaccgttgaaactcaggaacaaagcgaccgcgctgaaagcatcgcgaaagccgttgatggcgtaaaaagtgttaaaaacgatctgaaagttcagtaattcgtcgtaattcgtcctcccgacgtttgtcgggaggcgtaatgtgcaccacactaaaaatatcgcgaatgagtagcctgagcgctcatatttagcggtcgacattaactatggtaaaggagaggcttatgtttcgttggggcattatatttctggttatcgcgttaattgccgccgcattgggttttggtggactggctggtacggctgccggcgcggcgaaaatcgtcttcgtcgtcgggatcgtgctcttcctggtcagcctgttcatgggccgtaaacgaccctagcaggcatctgtaaagatatattgctatcaagccagtccagcggactggcttttacggttttagccgttaacgttttgcgttaccttgtcagcctggaaaaaaatgaaaaacaggaaggcagaggtgggccagcgaataccggttacgctcggcaatattgcgccgttatcattaacaccgttccggccaggccgtatggcgctggtctgtgagggcggggggcagcggggcatctttaccgcaggcgtgctggatgagtttatgcatgcgcagtttaatcctttccatctctacttcggcacatcagccggtgcgcaaaatctctcggcgtatctctgcaaccagcccggctacgggcgcaaagtcattatgcgctataccaccaggcgcgaattttttgatccgctgcgatttgtacgcggaggaaaccttattgacctcgactggctggtggaatccaccgccgcccggatgccgctgcagatggataccgcagcgcgcctgttcgacagcggaaaatccttttatatgtgcgcctgccggggggatgattacacgccgggctatttctcgccgacaaaacaaaactggcttgatatcattcgcgcctccagcgccataccgggtttctaccgtaccggcgttacgttagagggcatcaactatctggacggtggcattagcgacgccattccggttcaggaggcggcaaagcggggggcgaaaaccattgtggtgatccgcaccgtaccctcgcaaatgtattacacgccgcagtggtttaagcgtatggagcgctggctgggagagagcagtctacagccgttggtcaacctggtgcagcatcatgaaacgtcctacagcgcgatccaacaatttattgaaaagccgccgggtaagctgcggatcattgaaatttatccgccgaaaccgctgcacagcatggcgctgggcagccgtatcccggcgctgcgtgaggattacaaaaccgggcgattatgcgggcgttatttccttgccaccgttggtaaattgctcgccgcaacgccgcctctcttgcgccatacgtcgcggattgccgtgccggaaacggtggtcgtgcctccggcgccggtggccaatgatacgcatgtggcggaggtcattagcgcgccgcaggcaaacgacaccacatttaccgacgaggatctggcgtgagctggcgctttatcgatacacactgccattttgatttcccgccctttacgggcgatgagcgcgccagtattcagcgtgcctgtgaggcgggcgttgaaaaaatcatcgtgccggcgaccgaggcggcgcactttccccgcgtgctggcgctggcggcgcgtttcccgtcgctttatgctgcgctgggattgcaccccattgtgattgagcgtcatgccgatgacgattctgataagctgcaacaagcgctggcgcagcaacagaacgtcgtggcggtaggcgagatcgggctcgatctttatcgcgacgacccgcagttcgccaggcaagagcgatttttagacgcgcaactgcaactggcaaaacgctacgatctgccggtgatcctgcactcgcggcgcacgcatgacaaactggcgatgcacttaaagcgccaggatctgccgcgaaccggtgtggtgcatggttttgccggcagtctgcagcaggccgaacgctttgtgcgactgggctataaaatcggcgtcggcggcaccatcacctacccgcgcgccagtaaaacccgtgatgttatggcgcgcttgccgctggacgcgctgttgctggagaccgatgcgccggatatgccgctaaaggggtttcaggggcagccgaaccgcccggagcaggcggcgcgcgtatttgatgcgctctgcgaattacgtccggagcccgcagaggtgatagccgatacgctgtatcgcaataccattaccttgtttcggctctgatggcatcgcagccgccgtccggcaggcgacgcttacaaatatagcgccggcaaaatcagcttcgccaccccacgcgcgcgcaatccgtcagccagccgttccacctcttgcggcgtcgcgcctggccaggctttcgcttcgccatagacaccgtgcgcatgaaaggcattcaaacgcaccggaacctcgcccagcgaagtaataaacgccgccagtgaatcgatatgcgccgcatagtccacctgacccgggataaccagcaaccgcagctccgccagttttccccgcgcagcaagaaagcggatactgtgcttaatatgcgtgttatcacgtccggtcagacggtgatgacactcgctcttccaggctttcagatcgagcattacgccgtcgcaaaccggcagtagtttttgccagccggtctcgcttaactgaccattactgtccaccagacaggtcagccgttgtaactgcggatcggctttgatcgccgtaaatagcgccacaataaacggtaattgcgtggtcgcctctccgccgctgacggtaataccttcaataaacagcgatgctttacgaatatgacgcagcacatcgtcaacgctcatggtctgcgccattggcgttgcctgctgtgggcacattttcaggcaggtatcgcactgctcgcagacgtccgaccgccataccactttcccgccatcaatgctgagggcgtggtgcggacactgcgatacgcattccccgcagtcgttacagcgtcccatcgtccacgggttatggcaattcttgcagcgcaaattgcagccctgtaagaataatgccaggcggctgcctggcccatcgacgcaggaaaacgcaatgatcttactgactaaagcgcatctgttgttcatggctgactacgcgtggctgtcgttccaggatgcgggtattacgtgcggcttcttctcccagccaggtggtattcgtgcgcgagccttcggcgcgaaatttcgccagatccgacaggcgcaccatataaccggtgacgcgcaccagatcgttgccgctgacattggcagtaaattcccgcatcccggctttgaacgcgccaagacaaagctgaaccagcgcctgcggattacgcttgatggtttcgtccagcgtcagaatgtcgctgatcccggcatggtaaaaggcatggtgcggcgcgacggtttgcaaatgggtgatagggtccggttcatcgccatacggcagacgcgcgcccggcgtagtgccaatatcggaactgatgccagactgggcatggagcagcgcccgttgcttccagccatacttcactggcgtattttcgacgaaatccgccagttgggcgctgatacggtagcccagctcgttcgccgtatcattcttgccgtaacgggcggtcaggcccgcgttttcgcacagcagattcacggcttccgccagcccgtacataccgaacatcggcgcaaaacgttcgggctcgatcaaaccttcctgtacaagaaagctattctcaaagaaatgtgatttttcatagaggaattcacatcgtgaattaatgatggcgatctgctgtcggcagtagtgcggtagcgtacgtgaaaagaagtcatcgacagacgtactgcgttctgccacggctttcaggttgagacgtaccagcgtactgccgccgccgccaagcggtagcgagttataacaactgacgatgccataatggccttttgtgaaaattttatcatttacagggccattggaaatgtgtggcttactgcattcacaaatgtttttggcgacctccagcagcagatcgtccggcgtaatttccgcatcgtagataaacgtcaggttaggcgccacctgctttagctcggcatcggcgcgcaaaatcgctcgtgtgacaggcgtatcggcagggccaatattggcatgcataaaggcgtctggcagcgttctgtcgagataacgccagaaacgttttattcgaatatcgatcgcatcttgtgttagaattctaacatacggttgcagcaacgcatcaagctggccgagataaaccggcatggacgtcacggaaggaacgtgatgatacagaatggtgagtagggataacgcatcatccagatctttcgcgccttccagttccagccactgtgaaccgttagccagaaatcgggcgtaatcgggcaacacgtagcgcggtttgaagggggcgtgcccctcaaacatatcgcaaatgacgccttcatccagcgcctggcgggcatcttccggcagggtgggataaggcagggcgttttcagcttccagcgccagaaaatggcgtttttgttcaggcgtgagcaccgggctggtcacaatttgctggcaacgctgctggagcgcagtttcgcatgaggcaggcatcttcgtttcctctttatgccgggacgatgcgctattgtagaaaatggcggcaaaccgactttgatcctgatgcgcttatcgctcgaagaacagacggtgacggcgggataatttgattcagatctcattacagtaatgcaaatttgtacgtagttttcattaactgtgatgtatatcgaagtgtaatcgcgagtgaatgttagaatattaacagactcgcaaggtgaaattttatacggcaatgccgttggagaatgtcatgactgatttaaaagcaagcagcctgcgtgcgctcaaactgatggatctgaccactctgaacgatgacgacaccaatgaaaaagtgatcgcgttgtgtcatcaggcaaaaactccggtcgggaatacggcggcgatttgtatttacccgcgttttatcccgattgcgcgtaaaactctgaaagaacaaggtacgccggacatccgcattgcaacggtgactaacttcccgcatggcaatgatgacatcgatattgcgctggcggaaacccgtgcggcgatcgcctacggcgctgacgaagtggacgtggtattcccgtaccgcgcgttgatcgccggtaacgagcaggtgggttttgacctggtaaaagcctgtaaagacgcttgtgccgcagcgaacgtattgctgaaagtgattatcgaaaccggcgagctgaaagaagaggcgctgattcgtaaagcctctgaaatctccattaaagccggtgcggatttcatcaaaacctctaccggtaaagtgccggtaaacgctacgccggaaagcgcgcgcatcatgatggaagtgatccgcgacatgggcgtttccaaaaccgttggcttcaaaccggcgggcggcgtacgtacggcggaagacgcgcagaaattcctcgcgattgcagacgaactgtttggcgctgactgggcagattctcgtcactaccgctttggcgcatccagcctgctggcaagcctgctgaaagcgctgggtcacggcgacggtaagagcgccagcagctactaagctctgatttgccggatggcgctgcgcttatccggcctacaaatccaggcctgtaggccggataaggcgttagccgccatccggcgatgtaagccttctactcttttccctcaggagggtaccgtgtttctcgcacaagaaattattcgtaaaaagcgtgatggtcatgcgttgagtgacgaagaaattcgtttctttattaatggtattcgtgacaatactatctctgaagggcagattgccgccctggcgatgaccatcttcttccacgatatgaccatgccggagcgtgtttcgctgaccatggcgatgcgggattccggtactgtccttgactggaaaagcctgaatctcaatggcccgattgtcgataagcattcgaccggcggcgtaggggacgtgacgtctctgatgttggggccaatggtagcggcctgcggcggttatgtgccgatgatctccggtcgcggcctcggacataccggcggtacgctcgacaaactggaagcgatcccgggcttcgatatcttcccggacgacaaccgtttccgcgaaattattcaagacgtgggtgtggcgattattgggcaaaccagctcgcttgcaccggcggacaaacgtttttacgccacccgcgatattaccgcgacggtggactctattccgctgatcaccggctccatcctcgccaagaaactggccgaagggcttgatgcgctggtaatggacgtaaaagtcggcagcggcgcgtttatgccaacctatgaactttctgaagcccttgctgaagcgattgtcggcgtggcaaatggcgcgggagttcgcactacggcgttgttaaccgatatgaaccaggtgctggcttcaagcgccggtaacgcggtggaagtgcgtgaagccgtgcagttcctgaccggtgaataccgcaatccgcgcttgtttgacgtcactatggcgctatgcgtggagatgctgatctccggccagctggcgaaagacgacgccgaagcgcgtgccaaactgcaggcggtgctggataacggtaaagcggcagaagtctttggtcgtatggtggccgcgcagaaagggccaagcgatttcgttgagaactacgataaatacttgccgaccgccatgttgagcaaagcggtatatgctgataccgaagggtttatcagcgcaatggatacgcgtgcgctggggatggcggtcgtctcgatgggcggcggccgtcgtcaggcgtctgacaccattgattacagcgttggctttaccgacatggcccgtctgggcgacagcatcgacgggcagcgcccgctggcggtgattcatgccaaagacgaagccagttggcaggaagcggcgaaggccgtcaaagcggcaattatccttgacgataaagcgccagcaagcacaccttcggtctatcgtcgaattactgaatagttgtatactgatctgatcaattatttttgaagcactaagtacggagaagatatgaaacgtgcatttattatggtgctggactcattcggcatcggcgctactgaagacgcggatcgttttggcgacgtaggttccgacactctgggccacatcgcagaagcttgcgccaaaggcgaagctgacaatggccgtaaaggcccgttgaatctgcctaacctgactcgtctggggctggtgaaagcgcatgaaggctctaccggtaaaattgccgccggcatggacggcaacgcggacgttattggcgcatacgcatgggcgcacgaactgtcctccggcaaagatacgccgtccggccactgggaaatcgccggcgtgccggtgctgttcgactggggctatttcagcgatcacgaaaacagcttcccgcaggaactgctggataagctggtgaaacgcgctaacctgccgggctacctcggtaactgccactcttccggtacggtcattctggaccagctcggcgaagagcacatgaaaaccggcaagccgattttctacacctccgctgactccgtgttccagattgcctgccacgaagagacctttggcctggataaactctacgagctgtgcgaaatcgcccgtgaagagctgaccgaaggcggctacaacattggccgcgtgatcgcgcgtccgtttatcggcgacaaggccggtaacttccagcgtaccggtaaccgtcacgacctggccgtagaaccgccagcgccgactgtgctgcagaaactggtcgatgaaaaacagggccacgtggtgtccgtcggtaagattgccgacatctacgccaactgcggcatcactaagaaagtgaaagcgaccggtctggacgcgctgttcgacgcgaccctcaaagagatgaaagaagcgggcgataaaaccatcgtcttcactaacttcgtcgacttcgactcttcctggggccaccgtcgcgacatcgcgggctacgccgcaggcctggagctgtttgaccgccgtctgccggagctgatggagctggtgggggaagatgacattctgatcctgaccgctgaccacggctgtgacccgagctggaccggtactgaccatacccgtgagcacattccggtgctgatctacggtccgaaagtcaaaccgggctctttaggtcaccgtgaaaccttcgcggatatcggccagacgctggcgacctactttggtacatcgccgatggactacggtaaaaacatgctgtgatacctgttgtctttcgcgctgtagatgcgttgacttcattcgctcaccccggtcacatagttaatctatgctcccggggattcacgaattcgtcgccttcctacaacgcgaaatacttagggtatttcactgttttgacacacgttttgtaggcctgataaggcgtagccgccatcaggcaataacaacaaatttaaagggaactgaagatggcaactccacatattaatgcagaaatgggtgatttcgctgacgtcgtattgatgccgggcgacccgctgcgcgcgaagcacattgctgagactttcctcgaaaatgttcgcgaagtgaacaacgttcgcggcatgttaggtttcaccgggacttacaaaggccgtaagatctccgtgatgggccacggtatgggtatcccgtcctgctccatctacaccaaagagctgatcaccgatttcggcgtgaagaaaatcattcgcgtcggctcctgcggcgctgtgcgcatggacgtcaaactgcgcgacgtggtgatcggtatgggtgcctgcaccgactccaaagtgaaccgtatccgttttaaagatcatgacttcgcggctatcgctgacttcgacatggtgcgtaacgcagttgatgcggcaaaagcgctgggcgttgacgcgcgcgtaggcaacctgttctccgctgacctgttctactctccggacggcgaaatgttcgacgtgatggaaaaatacggcgtactgggcgtagagatggaagcggcgggtatctacggcgttgcggctgaatttggcgcgaaagcgctgaccatctgcaccgtatctgaccatatccgtacccacgagcagaccactgccgctgaacgtcagacgaccttcaacgacatgatcaaaatcgcactggaatccgtactgctgggcgataaagagtaagattgtgaagggggccagagcaggcccccttcatcgtttatttcgtcagcacttcccactgtaaattgctttctagcatgaccgtatcggtagcatgcgtaaattgattatcgttcaagacaggtgttaatgtcagcgtgacgttcatcattttcccactgacctgctggttattatccatcgcgatgataccgttgttattatgtagcaacagactatccagggcactgtcattgggagcaaagctcactctatcaagggtgctggcaataggataacttttaccatctactatcatctgactaacacgtacggcgagaccaccgttatttccaaaataaaatcgtcccttttcccccgctgaggcctgcacaaaaagagcaatattctggctttctgggcaactcacactaacgtgaacctcctgtgaagacatttgattccagccttgctgagaattgacgatatcatcttgcttaagccagccaaagctgacgtttggcgaagaaaacgttatttggcagtcatcgtcggcccgggctgatggggggagtagtgcggtgaagatacaacatatagcaatccccaaccatttgctgttggatttcattgacagactccctttgccgtttcataaaatgcctctttatcctgggttttctgcagcgtgtagtggatgcgacacagacgattcatatcatcatcagcggcatataacgcaggattatccccaacatcggtgataaatacgcgtccgctgtcgacagcgctgaccaaatagttatttttttcatctacaatgctggtgcctttaggtagccatgagccatccggacgctttactgccagcatcacacggcgtgtattcagcacgttgaaatccagtacccgaaaagcgctgtgcgcgacggtaatattcttaataccgtttgccagttccatactctttggtagcgtattcgcattaacctctacgcgggatttccgccattcagttagccccggaatgacggcttgcccccagtggtcagtccagattcgcccctgtggcgtggcgatttcaatgccgctttctggttcactcaggcgtgcgatagcaaaggtatttttgattgtataaggcgagaacgttatgccatgttcgtgtgcagcgatgcctccgctgaaggttgcgttatagttgcggtaattatcgccatcagtgccgccgcccacgctgagttgagtgtaatgaagattgctattgagattaccgttgaagctattttgctggttttttgcatcacgatccgcagaaatatagtaatgggtatctttactcagcgaaccattattttgtagcccgtaggttgttttatcaccttgattacgcatataagcgccgacgcgctgctcacctagtggaatgctgatgttgatgtaaaacatatcatcatcattactgtcgttatgattctcatcatcctgattaacagcgtgctgccagttagcggtaattgaggcatatttaaacgttttgccccaggaagccattatactgcgagagtcgttgtcattatccgtagcctgataagtgtaataacccagagagaaggtacctaacagattatggttccaggcaatattagcactggagctactttgatattcgtaagcatctttattgagcgcatccgttaactcacgatatccgtcgctgtagcgggcggtactgacgtcaagtctaatttccccgggcagcgccatgctggcgcgtagttcacttttcgcaccctgcagagattcgccaaaggacgctttactgcccagcattgagccggaaaacgtccatttattggttggaagccattgcagcatccctcctgccgcttgatagtcttgtgccagtacgccagacgcctgcgccagccagttttcactcagtttccaaccatcgctgatgttatagatccaggggagcgaatagtcgctggtggtatcacgtatgcgccctatggacattgttaagcctgcgggcgtgagttcgcgtaaattaaaggatactgccggcaccgtgaaggttgtcgttgagccatcggtttcaacgacgctgacgttaaggtcggtattgctgcgtatgatggggacattttcaagggtaaatgccccagcgttcactggtgcggtataaataatctgtccggactgacgaacttcaacgcgagcctggtgggttcgggcaataccgttaatggttacgccttgtgtatcctgtgccagcccttgttcagggataagctgtacgccgttgatcggcgcgccactgaatagactggagttgacgttgatctgcccaacttgcgcacgcattttttgtgcctgaaatacgtgctccgcataggtatatagactatcggtacggtattctccatcattattcgtcagcatgtagcggctgcgcagcgtccattccgcgaagtttaagccagcttcaaggtttgcctgggcatagtttcggctatcgctaccggatgactcgctgcgactggcgtacaggttatagttaaataacccggcggtgccgcctttaatcacgttgtttagcgatagtaagttattatccagagcctgtgccggaacaaaaagctccagcgattcactgtttggcagtggggtaataatcgctgagggataatcttcttgtaggctatggcaggtttctttggcgctgatattaagcgaaacgagcccgctggcgctgaggaaatcgtcatccacgcaaagctggccttctgtgtcgaaacgcgcgaccaacgaccctctatttacgccattgatctttaccatgacggtgtggctgcctggtagaaagcgcggcgcgcgggaaaaatattgtgcgacgttggggctaatgcctctggaggtgagaatacccatgtcaaaattcagctcctccgccagagctgaaaacgtcgtggttgccagtgagcaataaagcgcagttttgatgtatagcggcagttttaaatacttcacgtgctagctctcattacggcaccagcggtgaggtaaagctggggacttcaatgccgtaacggctggcaggataaaaacgtacggatgtatcagcagcaaagggcgtttttatactgacgttcaatgtttcgccgggcagaatataggtttttttaatcgtgccttcgcccccggaaggtaagaaggtaatattttgggctaaacgtacaacgtagggagacggatttttgacgttgattgtttgtccgtttctggaccaggttaataatttccaggcatcagtaacgaccggtagatttttaggacgaattaataccggcaaatcctggcgtagattaaaacctattttcattcctttatcggtagatttcggaggaataccttcaaacgtgacgcgcttatagtgctcgacggtgagcggttccgtactttccataataaagcgtagttgctgctgctggcctgcttcaacgcgaacaactggttgagtgacatccagtttcacaccattgtcgtcaggtaaatcaacgacggtggtatataacaaagccggattgctgtcggtgtttttaacattcattacgccgctgtgtgtggattcttcaatcaccagtagcgtagtttccggtaccatgccggcagcgttagcctgtgaaaagagtgttgaaaaaacaaaggggacgctgagtaataataatggaagtttagtcactgctggcatcagaattagtcctttaattttaatctgtctccccataataagggagacagatcaataacctttttacacggtctggatcagagatatttaagcgtgatggttgcctgaccatccagatcagtatcatcagtaatggccagcgttgcagtattctgaatagccagtgaggttttcagcgggaaaatggcgagggtatacggaaccggttcggtggtgccttttgtagcaacggtaaacatttccatattgccgtttttgataatcccggtggaagacttctgccagactgggctatcaacggttcctgagatagcgtcagattttacaccatcagcggtaacgttcgcggtatcggtataaatagagaacgcgccgatttttacaccttcggttgttttgccaacgccgtaggacattgtggtatcagatactatactattagtcatatcgccattggctatggagataacggatgcgcctgggtgggtgtccgcacggtcatcggtaatagtccatgctgctttggttgcagacggacaagagatactcagagagacatctttagtacccagttggtttacatcggttgcggaaagtgtggcgaggcggatagtaccgtaatcaaccacgccgccgccgctgagttctggggtacaaccaccaacaaccagttgaccggtgacttttaatacggcagtagtgtcagcattcacgctggttgtagcaaaggaagctgcaattgcagtaataagcaaaatttttttcattatagttccattaaagaggtgttgaatattccatgtgaatgctggagttacagatatacgagtgtaaaggtcgcctgaccatcaagcgtggtgttatcggtaatagccagtgtgtccgttccctgtatagcggcagctacgcgtataggaaatgttgcggtggtaaaagcaacggggccatttccatcgccgacactatatgtagtgcgggttggaaatgtatttgtaagcgcaacgtattcgtttgatgctaaagcccagacaccaggattcgaatcatttgacgctaccatcttcgtcttaactccatcggcggtcgaattattcgcgtctatggagaggccgtatgcaccaatcttgataccatctgctgttgtacccaggcctagctgatagtttggtattctattgttctgaccgccaaatgttgcgttatcgatagtcagcgttgtcgccgaatcgccatgattgtcggtagcgacccagccaacttttgccggtgcaaggcactgaatcgtgagtgttatatctttgtatcccagttgattcgtctgagttggcagcagatcgctaacggccttagtaccgaaatctacaacgccaccatcacttaactctggtatacatgcgccgttggttaaaacgccagtcagttttaatacagcagtggattcaaccgcttgcgctgaagttgataatcctattatgacagaggtcgctattaataattttttcatcagtaatccctaacgattaagtatatttccaaatgacatgtaatgcgcgggtcgggattctatgaagataatgatatgttgtaaatttaataaaattaaatcttggttaagaaaaactttaatcatcattggtgatgataaatggtttataattcgctgggtttatgaagtgcggggaaataatattaattttaaagaatatagtagttagtgagtgtgttttaactatttgtgctattcactcatttttcagaatatgttgttatgtttaaataatatcagagacacattcgtctctctgatattattcatttagcgcacagcttctgcaatccacgccgacagttcccgcagttctttttcctgctccgggaaatcaaccagtagcgcctcgcacgtttcctgtagtttatccgcgcggtacaaacacccttgcagccgctcggccagcgcttccagcggtgccgggttcaggctatcggtaaatgcctgtgcgcgggtaatcacacctttctcgacgtcaaaatgcagctcgacgccgccccaggtgaaacgctcgtccagcagatggctgaacgctggtgcctggccgaaattccactcccaactgctctggcgcgcaaaggtttcggcaaaattcggcagatccggcgttttatccggtgaaatcacttccgcgtcgacgcgttcgccgtaatgggcgaaaaaggcttccgtgaccgcctggcagacctgttcatgggtgatacccggtaatagctcggtaagattggccacgcgggagcgaacggaggtgattcctttcgccgcaagtttctttttatcgggattcagatagtttgccagacggctgaggtctgcattcagcagcagcgtaccgtgatggaagccgcgatctttggtttcgcgataggctgaaccggagactttgcgatcgccgtccggcgtttttacgaccagatcgttgcgtcccgaagcatcggccatgacccccagcgaattcagcgccgcgagcacaatatgggtggagatggttttatcgtattccggtttaccagccataaaggtaaagcaggtattaccgaggtcatggaataccgcgccgccgccgctgctacggcgggccagacggacattatcttcttccatacgccgcgtattacactctttccacgggttttgcgcgcgtccaatgaccaccgtatccgcgttgcgccacaggaacagcacgcgctgggtggcgggcatctggcggaaaatgcactcctcgaccgccaggttaaaccagggatcgtaagagtcagaaataagcaggcgtaatgttgtcatagtggttttccttacctttattaagccgtcattttactctttttcctcacgctcttcctcttccggaacaggcttgctggccgttagcaggaagggcgactgctgccagcgggtgcgtttaccttgtagcaaggtgcgcgtcagcaccacgcctatcgccagcgagagtagcagcatcaggcgtagaatgttggtggtgttatcgacctgctttgcttcggtggccagcgtgtgggtatccagcgttagacgcaggtagcccaatgggccgtttttcccctggataggctcgacaatttgttggttaaaatagctgcccgcttttttgccatccagcgccagcctgtcgcgcacattgacgctttcgccagcgcgagtaataagatcgccctgttcatcatagacgccggcatccagaatacggctctcttgcgtgagctgacgcagcacggcgttgatgcgattttcatccggtgtttcgctgcgcatcagcggggcgatgttgagcgtcacctggcgcgccagcgtgcgggccagctcttccagctgcgggttgcgctgtcgctggtggttttgactaaaccaggacgcgccctgcataagcgcgacgagcagtgtgagacagaacaatacaatgactgcacgatgcagccgaaatttcagttttgcgcgagccatattccacctgctgaaaatttgaggcttaatgttgccagaagcgatggttacaaggtagcctcatgcgttattttccgcggggcggttaccggcctgaacgatttacaggagctttaatgcctaacattacctggtgcgatctgcctgaagatgtctctttatggcctggtttgcctctttctttaagcggcgacgaggtgatgcctctggattaccatgcaggccgcagcggttggctgctgtatgggcgcgggctggataagcagcgtttaactcaatatcagaccaaactgggcgccgcaatggtgattgtcgccgcctggtgcgtggaggattatcaggtcattcgtctggcggggtcgctgacgccgcgtgcgacgcggctggcgcatgaggcgcagctggatgtcgcgccgctgggtaaaattccgcatctgcgcacgccggggctgctggtgatggatatggattccacggcgatccaaattgagtgtatcgatgaaatcgcgaagctggccggtaccggtgagaaggtggctgaagtgacggagcgcgcgatgcgcggcgagcttgattttaccgccagcctgcgcagccgcgtggcgacgctgaaaggcgcggatgccgatattttgcgacaggtgcgcgggaatctgccgctaatgccaggattaacgcagttggtgctaaaactggaagcgctcggctggaaaatcgctatcgcctccggcggcttcactttcttcgccgactatctgcgtgaccagctacgtctgacggcggcagtcgccaatgaactggagatcatggacggtaaatttaccggccacgttatcggcgatattgtggatgctgagtataaagccaataccttgcttcgtctggcgcaagagcatgacatcccgctggcgcagacggtggcgattggcgacggcgctaacgatctgccaatgatcaaagcggcagggttaggtattgccttccatgccaagccaaaagtaaacgaaaagacggagattacgatccgccacgctgacctgatgggcgtgttttgcattctctccggcagcatgaaccagaaatgattaacctgcccaatggcaaggcgaccgtaggccggataagcgccagcgccatccggcaacagcgttaacgaaagaggtaaaacgtggcaaaagctcccaaacgcgcctttgtttgtaatgaatgtggtgccgattacccacgctggcaggggcaatgcagcgcctgccatgcctggaacaccattaccgaggtgcgccttgccgcgtcgccgacggtggcgcgtaacgaacgtctgagcggatacgccggcagtgcgggcgtatcaaaagtgcagaaactgtctgacatcagtcttgaggaactgccgcgcttttctaccggttttaaagagtttgaccgcgtgctgggcggcggggtggtacccggcagcgccattttgattggcggtaaccccggcgcgggcaaatcaacgttgctgctgcaaacgctgtgcaagctcgccgagcagatgaaaacgctgtacgtcaccggcgaagagtcgctacagcaggtggcgatgcgtgcgcaccgtctcggcctgccgaccgctaatctgaatatgctctccgaaaccagcatcgagcagatctgcctgatagcggaagaagaacagccgaaactgatggtgatcgactctatacaggtgatgcatatggcggatatccagtcgtcgccaggcagcgtcgcccaggtccgcgaaacggcagcctacctgacgcgcttcgccaaaacgcgcggcgtggcgatcgtgatggtcggccacgtcaccaaagacgggtcgctggcggggccgaaagtgctggaacactgtatcgattgctcagtattgctcgacggcgacgctgattctcgtttccgcacgctgcgcagccacaaaaaccgctttggcgcagtcaatgagctgggcgtcttcgccatgaccgaacaggggttgcgcgaagtgagcaatccgtccgccatctttttaagccgtggcgatgaggtcacttccggcagttcagtgatggtcgtctgggaaggcacgcgaccgttgctggtggagattcaggcgctggtcgatcactcgatgatggcgaaccccagacgcgtggcggtcggtctggaacaaaaccgtctggcaatcctgctggcggtgctgcaccgacacggcggtctgcaaatgtcggatcaggacgtcttcgttaacgtggtcggcggcgtgaaagtcaccgaaaccagcgcggatctggctttactgctggcgatggtctccagcctgcgtgacaggccgttgccgcaggatctggtggtgtttggcgaagtggggctggcaggcgagattcgtccggtgccgagcgggcaggagcgtatttccgaggcggcgaaacacggctttcgtcgggcgattgtgcctgccgccaacgtaccgaaaaagccgccggaaggaatgctggtgttcggtgttaaaaagctcgcagatgcgttaagcgtgtttgacgacttataattctctgtatgtagtgatgttgtataatttgccggatggcgatgcaatgcgtcttatccggcctacggattgatacggattgatgttgtaggcctgataagcgaagcgccatcaggcagtgttatgcgatttttccagcaggaggctcttgtgtcatcgttcgactatctcaaaaccgcgattaagcagcaaggttgcactctgcaacaggtggctgacgccagcggtatgaccaagggatatctgagtcagttacttaacgccaaaatcaaaagccccagcgcgcaaaaactggaggcgctacaccgttttctcgggctggagtttccccgccgacagaaaaacattggcgtggtgttcggtaaattttatccattgcataccggacacatctacttgatccagcgcgcctgtagccaggtggatgagttgcacatcattatgggatatgacgatacgcgcgaccgcgggctgtttgaggatagcgccatgtcgcagcagcccaccgtgtcggatcgcctgcgctggttattgcaaaccttcaaataccaaaaaaatattcgcatccacgcctttaatgaagaggggatggagccttatccgcatggctgggacgtctggagcaacggcattaaagcgtttatggcagagaagggaatacagccgagctggatctacacttccgaagaggctgatgcgccgcagtatcttgagcatttagggattgagacggtgctggtcgatcctgaacgcacgtttatgaatatcagtggggcgcaaatccgcgaaaatccgtttcgttactgggaatatattcctaccgaagtgaagccgtttttcgtgcgtaccgtcgcgattctgggcggggaatcaagcggcaagtctacgctggtcaataagctcgccaatatttttaataccaccagcgcctgggaatatggccgcgactatgtcttttcgcatctgggcggcgatgagatggcgttacagtattccgactacgataaaattgcgctgggccatgcgcaatatattgatttcgcagtgaaatatgcgaataaagtggcgtttatcgataccgatttcgtcaccacccaggcattttgcaaaaaatacgaaggacgcgagcatccctttgtccaggcgctgatcgacgagtatcgcttcgacctggtgattttgctggagaataatacgccgtgggtagctgacggactgcgaagcctgggcagttcagtggatcgcaaagcgttccagaacctgctggtcgagatgctgaaagagaacaacattgagttcgttcacgttaaagaggctgattacgatggtcgctttttgcgctgtgtggaactggtgaaagagatgatgggcgagcagggataagaaccaatgcctgatgcgacgcttaccgcgtcttatcaggcctacagtttcacaacgtactggaatcgctgggtttgtaggccgggtaagcgcaagcgccacccggcattcagacatttatttggcaatacgcttgtacttgatacgcttcggctccagcgcctcggcgcccagcgtgcgtttcttgtactcttcgtattcggtaaagttgccttcgaagaattccaccttaccttcatcctgataatccagaatgtgggtggcgatacggtcaaggaaccaacggtcgtgcgagataaccatcgcgcagccagggaactccagcagggcgttttccagcgcgcgcagggtttcgatatccaggtcgttcgtcggttcgtcgagcagcaggacgttgccgcccacctgcagcagcttcgccagatgcaaacgaccgcgctcaccgccggacagttcgccaacgcgtttgccctgatcgacgcctttgaagttgaagcggcctacataggcgcggcttggcatttcagtgttgccgatcttcatgatatccagcccgccggacacttcttcccagacggttttgctgttgtccatcgcgtcgcggaactgatcgaccgaggccagcttgacggtttcacccagcgtaatggtgccgctatcgggctgctcctgaccggacatcatgcggaacagggtcgatttacccgcgccgtttggcccgatgatcccgacgatagcgcctttcggcaccgagaagctcaggtcgtcgatcagtacgcggtcgccgtaggatttacgcaggttgctgacttcaatgactttgtcgcccagacgcggtcctggtggaataaacagttcgttggtttcgttacgtttctgatactcaacgctgttcagttcttcaaagcgagccagacgcgccttacctttcgactgacggcctttcgcgccctgacgcacccactccagctctttctcaatggatttacggcgcgccgcttcggcagacgcttcctgcgccagacgctgatctttctgctccagccaggaggagtagttgccttcccacggaataccttcgccgcggtcaagttccagaatccagccggcgacgttatcgaggaagtaacggtcgtgggtaatcgccacgacggtaccttcgaagtcgtgcaggaaacgttccagccacgcaacagattcggcatccaggtggttggtgggttcgtcgagcagcagcatgtccggcttttccagcaacagacggcacagcgccacgcgacggcgctcgccgccggacagtttttcgactttggcatcccagtccggcagacgcagagcgtcagcagcgcgctcaagctgcacgttcagattatgaccgtcgtgcgcctggataatctcttcaagtcggccctgctctgcggccagcttgtcgaagtcggcatccggatcggcatacagcgcgtacacttcatccagacgtttgagggcgttaaccacttccgaaacggcctcttcaatcgactcgcgtaccgtgtgttccgggtttagctgaggttcctgcggcaggtagccaatcttaatgccgggctgcgggcgcgcttcgccctcgatatctttatcgagccccgccatgatgcgcagcagggtagacttaccggcgccgttaaggcccagcacgccgattttggcgccagggaagaagctcagcgagatgtttttcagaatatgacgtttcggcggaaccactttgccgacacgatgcatggtataaacgaattgagccacgttggacttcgcctctatgtttatcgtgatggtgaatagatgtcaaaggcgaagtgtagcctttttccctgcctaagcccagccagcagatcgcactcgcaataaaagtaaaaaagtgtccgtaacgtggcgcaaatggctatgactggttagcataaattcattacgcggcatgatgctgcattggataacaattgaggaagtgcttgtggatagagccaaaccatttgtctggcgtctcgtcgccgccagcgtatgcctgctgaccttttgtcacctcgcgcgggccgactcactggaagagcagcgtaaccgctatgcgcagattaagcaggcctgggacaaccgccagatggatgtggtagagcagatgatgccgggtctgaaagattatccgctctacccgtatctggaataccgtaagatcaccgacgatttgatgaaccaaccggcgattgctgtcacgcagtttgtgcgcgccaatcctacgcttccgcctgcgcgtacgctgcaatcacgcttcgtcaatgagctggcgcgtcgtgaagactggcgcggcttgctggcgtttagcccggagaaacccggcaccacggaagcgcaatgtaactattactacgcgaaatggagtaccgggcaaacggaagcggcctggcagggcgcgaaagacctttggctgaccggcaaaagtcagccgaatgcctgcgataaactgttcagcgtctggcgggcctccggcaagcaagacccgctggcgtatctggaacgtattcggctggcgatgaaagccggaaatacggggctggttacggtgctggccggacagatgccggcggaatatcaaacgatcgcctcagcgatcattaccctcgctaatgaccctaataacgtgttgatctttgcacgcaccaccggcgccaccgattttacccgccagatggcggaagtcgcgtttgccagcgtcgcccgccaggacgcggaaaatgcgcgtctgatgatcccctcgctggtacaggcgcagaaacttaatgaggaacaaacgcaggcgctgcgcgatatcgttgcctggcgactgatgggcaacgatgtgaccgatgcgcaggcgaaatggcgcgatgacgcgattatgcgctcgcaatcgacgtcgcttatcgagcggcgcgtgcgtatggcgctggggatgggcgatcgtcgcggtctcaatacctggcttgcccgcctgccaatggaggcgaaagagaaagacgagtggcgttactggcaggcggatttattgctggagcgcggtcgtgacgccgaagcgaaagagatccttcatgctttaatgcagaagcgcggtttttatccgatggttgcggcgcagcgtttaggcgaagagtacacgcttaaaatcgataaagcgcccgccaacgtaaacagcgcgttgacgcaggggccggagatggcgcgtgtacgggagctgatgtactggaacctggataacacggcgcgcagcgaatgggcgaatctggtaaaaagccgtagtaaatctgaacaggcgcagttggcgcgctatgcgtttaaccagcactggtgggatctgagcgtacaggcgacgatcgccggaaaactgtgggatcatctggaggagcgtttcccgctggcgtataacgatctttttacccgctatacccgcggaaaagatatctcacaaagctatgccatggcgattgcccgccaggagagcgcctggaacccgaaagtaaaatcgccggtaggggccagcggcttaatgcagattatgccgggaacggccacccatacggtgaaaatgttttcgattccggactaccgcggccccggccaactgctggagccggagaccaacatcaacattggcaccagctatttgcagtatgtctatcagcagtttggtaataaccgtattttcgcctcggcggcgtataacgccgggccggggcgcgtgcgcacctggcttggcaatagcgccgggcgtatcgatgccgtagcgtttgtcgaaagcattcccttttcggaaacgcgcggctacgtgaaaaacgttctggcctatgacgcttactatcgccactttatggggcagaaagaggccttaatgagcgactctgagtggcagcgacggtattaatgcagacgggttatgttatcatttgtactcgtgtaacagtacaaacggcggtataacatgacccagcattccccttattcatcggctatcgccgaacaacgtaatcaggagtggcttcgttttgtggagttactccgtcaggcatatgcagaggatctgcatctgcctttattacaactgatgcttacgccggacgagcgtgaagcgctgggaacgcgcgtgcgcattattgaggagttgttgcgtggcgaaatgagccagcgcgagttgaaaaccgagctgggggcgggcatcgccaccatcacgcgcgggtcaaacagcctgaaatccgcgccggttgaactgcgtcattggcttgagaacgtactgctgaaaaacgcctgatttgctcgtaggccggataaggcgaagcggccatccggcaacatcgccgcgaaatgcctgatggcgctgtgcttatcaggcttacaatatagcgcaaataattatcgatacaccgcgttatgaaacgggctgagcgccaggatcaccgcctggtagtaaacgctggagcgcgttaattttccggcggtaaatacgccaatggcgccctctttacgaccaatctcatcaatacctgtgtactgcgacattaccgggccaagcgcttctccctggcggactctgtcgagaatgacggcgggcagcggtagcgtggccgatcgcgcttcaccgcgctgaacgccgttatcaatcaccacccaactgaaggtggcgtcatcgtcaattccggcttcaatggctacccagaaatcagcttgtggatgcaggcgtcgcgcattatccacgcgatttcgtgcgccagcacgcgtttcctcgcttccgaagggctgctccggtacgccgctctcgacggcgacgggcgtaatatggcacgatccttcgccgaaaatctcttcaaatgcctgtagaattgcctgaattttggcaggattggtggtcgcagagataacctggtgcataattaagctcagttttaaaaatttatcgcagtataacggaaaaaaaacatgttacaggtataccttgttcgccacggtgaaacgcagtggaacgccgagcgacgtattcagggccaatcggacagtcccctgacagcaaaaggcgagcagcaggccatgcaggtaggagaacgcgcccgtagcctcggcatcacccatatcatcagcagcgatttaggccgcacaaaacgcacggcggagattatcgcccaggcgtgcgggtgtgatatcacctttgactcccgcctgcgcgagctggatatgggcgtgctggaaaagcgccagatcgattcgctgacggaagaagaagagggctggcgtcgtcagctggtcaacggcacgcaggatggccgcattcccggcggggaatcgatgcaggagttgagcgatcgcgttcatgccgcgctggcgtcctgtctggagctaccgcagggcagccgacctttattggtcagtcacggtatcgcgttgggctgtctggtcagtactatactgggactacccgcctgggcggaacgccggttacgtttgcgcaactgctctatttcccgcatcgattaccaggaaagtcagtggctggcgtctggctgggtggtagaaaccgcaggggacgtttcgcatctggacgcccctgcattggatgagctacagcgttaacggcgaatcgggatcagaaattcgcagcgcaggttgatagggcgatcgccggttttggtatcttctgacgggtagtatcgctctatatcctgtcctttacgacgggtcagattcagcattggcatacaggtgccgtaaacggtcaggataaaatcctgcacgccggttcctaacccttcataggtgaacatgacgtattcaccaccctgcaacagcacgggatgcgccgactgaacatagccatcggcctgctcttgcggcagtgcggtggtatagaatacttcctgctcatcgtctttctccatgctggggcgcgtttcattaagcccataaagcactggcggaatagttggcgaatgaccgaggaaatcatgccagaattgcacgcgcatttcgtggcggaagtcggaaatctgttccagcgagcaggaatagctctgcgtgacgccaaggagcggcgtatcttccagcgtaacgaactgatgttccggcacggtaaactcgcccagccgtaatggcgggcgaatgccaaaggcgctccattccgaggagcggcgatacagcgctggcgtctgggaaaactgtttcttaaaggcgcgcgtaaaggtttgctgagaatcgaagcggtactgaagagcaatatccagaattggacgcgcggtcaaacgcagcgccactgctgatttcgataaacgacgggcgcggatgtaagcgccaatggcgtggcccgtcacgtccttaaacattctctgcaggtgccacttggaatagcctgcttttgccgccacattgtcaagtgacagcggctgatccagatgaccttccagccagattaacaggtcgcgaattatgccagcctgatccataaaatatccccatcctttcaacaacgagcacccgatatcaggtaagaggataatagcattttttgttcttttagcattcagtgttttttttgagcttaaatgctttttttaggcaacgtgacaggtaattattctaatcctgtgatctataaccattttattttagaatgtctaataattacgcaacgtaacttttatgaatggtaacaatatgaaatacaagagcttagtacttttctcaattttgttgctgctggggcagagcgcccgcgcggaacaaattggttcagtcgatacggtatttaaaatgttcggtcctgaccataaaatcgtggtggaagcttttgacgatcctgatgtcaaaaacgtgacgtgctatgttagccgggcgaaaacgggcggcataaaaggcggattggggctggcggaagatacgtctgacgccgctatctcttgccagcaggtcgggcctattgaactgagcgacaaaattaagaacggcaaggcgcagggagaggtggtgttcaaaaaacgcacctcattgatatttaagtcattgcaggtcgtgcgtttctatgatgagaaacgcaacacgctggcgtatctggcctactccgacaaagtagtcgacgggtcgccgaagaacgccatcagcgcggtgccggtcatgccgtggcgacaataacagggaaagagtatgcagcaaccgcaggtctggttagtcgaggatgaacagggaatcgccgatacgctcatctacaccctgcaactggaagggtttaccgttgagctattcgctcgcgggctgcccgcgctggaaaaagcgcgtcagcaacggccggatgcggtgattctcgatgtgggactaccggatatcagcggctttgagctgtgtcggcagttgctggaacgccatcctgcgctgccgattcttttcctgactgcccgtagcgatgaagtggatcgattgcttggtctggagattggcgcagatgattatgtcgccaagccgttctcgccgcgcgaagtgagcgcccgcgtgcgcacgctgctgcgccgggtgaaaaagtttgctgcgccgtcgccggtggtgcgtaccggacattttgaactcaatgaaccggcggcgcagatcgcctggtttggtacgccgctctcgctgacgcgttatgagtttctgctccttaaaaccctgctgctgtcgccggagcgcgtgtactcgcgccagcaattgatggatattgtctggtctgatgcccaggagaccttcgatcggacggtcgatacacacatcaaaaccctgcgcgctaaactacgcgcgatcaatccggagctctcgccaattaacacgcatcgtggaatgggatacagcctgaggagcgtctgatgcgcatcggaatgcgtttgctgctgggctactttcttattgtcgccgtcgccgccgtgtttgtgctgtctatcttcgttcaggagataaagccgggcgtccgccgcgcgacggaagggacgctgattgacaccgcaacgctgctggcggcgctggcccgcgacgatctcctttccggcaacccgactgacggccagttggcgaaggcattcgcccaactgcaacatcgcccgtttcgcgccaatatcagcgggatcgtcaaagtgcgcaatgaataccatatctacatgacggatgcgcaggggaaggtgttgtttgattcggaaaacaaagcggtggggcaggattattctcgctggaatgacgtctggcttacgctgcgcggacagtatggcgcccgcagcacggcaaaagatgctgccgatcccaatagcaccgtgatgtacgtagccgcgccgataatcagcgatggacggattatcggcgtcctgactgtcggcaaaccgaatgcggcaatggcgccggtgattaagcgcagcgaacggcgcattctgtgggccagcgccgttttactgggaattgcgctggcgattggcgcggggatggtctggtggattaaccgctccatcgcccggttgacgcgctatgcggattccgtcaccgaaaaccgcccgcttgcgttacctgcattaggcagcagcgagctgcgtaaactggcgcaggcgctggagagtatgcgcattaagctggaaggcaagaatgagattgagcagtatgtgtatgcgttgactcatgagctgaaaagtccgctggcggcgatacgcggcgcggcggagattctgcgtgaaggaccgcccgcggatgtggttacccgctttacagagaatatactggcgcaaaatacgcgaatgcaggcgctggtagaaaccctgctgcgccaggcgcggctggaaaaccgacaggatatccctctcgcgccggttgctgttgatgagctatttacgcagcttagcgaggcgcgcagtattcagttggcggcaaaaaagatcacgcttactctacggccttcctcgctggttgtcgtcgccgacgcggagcttctggcgcaggcgttgggcaatgtgttggacaatgccatcgactttacgcctgaaaatggcgttatcacattaagcgctcagccgatgggggagaaagcgatcctgcaggtgacggattccggctgtggtattcctgattttgcgctgccgcgcattttcgaccgattctattcgttgccccgtgaaaacgggcgtaaaagcagcgggcttgggctggcgtttgtcagcgaggcggcgcggctcctcaacggtgaggtgacgttgtgcaatcgtcccgaaggcggcgtgctggcctcgttgacacttcaccgtcacttcacataacttcaaattctccccacatcgcgttcttacactgctggcattgcaaaggagaacgctatgttgaaatcccccctgttgtggaaaatgattacgttaggcggcgccatgatcctgctgttaattcccctgatgatggtacggcacaccatcgtggagcgtgctgattatcgaagccatgtagaagccgctattcgtcagagtaccagcggcccacaaaaggttgtcggcccgctggtggcgattccggtgacagagctctataccgtgctggaagaggagaaagaggtccagtataagcgcagctatctctatttttggctgccggagtcgctattggttgaaggcaatcaaaacgttgaagcgcgaaaaataggtatttatcaggggcaggtgtggcataccgatatggcgataaaggcggagtttgatgtggcccgtctgcatgagctgaacagaccgaacattacccttggaaagccctttatcgtcgtgggcgtcggcgatgcgcgcggtatcagcgcagtaaaagcgccgcaggtgaatggtgaaacgctcactgtagagccggggaccggcttaccggaaagtagagagggcattcatatcccgctgccggacagtcagtgggcgacgcgcaacctgacgttggatatgtcgctaaatttaagcggaaccggcagcttttcactggttcccgtcgggcgtagcagtgaaatgaccctggccagtaactggccgcacccaaattttgtgggggattttcttcccggtaaacgcgaaatcagcggttcaggatttcaggcccagtggcaaaccagccggtttgccacgaatctcggcgaacagtttgctgatgcgcaaaaggtggattgggacaacttaccggcgtttagcgtcgctgtatcgacgccagccgatcagtatcaactgacggacagagcgacgaaatatgccattttgttgattacgctaacgtttatggcgttctttgtcttcgaaaccctgacggggcagcggttacacccgatgcagtatctgctggtggggttatcgctggtgatgttctacctgctgttgctggcactgtcggaacatatcggtttcacgccagcctggatcgccgcaagcctggtgggcgcgttgatgaatagcgtttatttgcaggcggtgctgaaaggatggcgcaatagcgtgctgtttacgttagcgttattggcgctggatggcgtgatgtggggattgctgcgttcggaagatagctcgttgcttctgggtaccggcgttctgctactggcgcttggcggcgtgatgttcctgacgcgccatctggactggtattcgctctcttgtcagcaacgtaagtcattaccgccagtaaaagatgacgaattacgtttgtggaaataaatctaacgggcgcgcgcgttaacgttttcccgcgcagcgccagaaactgtgatgccgttagttataggtcaggtttaatgttgccgtggcattcgcttgcccggccgttaccgtggcggcggttttatagtagcgcgcgctaattttcagggtggtcgacatattcatggttccgccgttaaccgtctggctgccatcggcattggtggtaatcgtgtgagtaaagagatcaattttttgattgattggcaaactgccggtaaagaaaccggcgtccggcgcctgaatacccaactgtacgccaacgccggttgcgctggttggcgcgctcgcattgctcaactggatgactgaattatcagggttatttccgctggccggttgggcgcttaacgatgcggaaatagcggtgccttgttcgcaggtcaataggatatcctgctcgcctgtgcccgcggtttgactgttagcgaaactgcctaaattgacgctgcctaaatccacggtgatggcaggtgtttctacccgacatcccatcgctttcataatcaattgcgtattccccaaatacagatgggtcaggatatcgccgccggagtcttccgttgcgctatcgcgaaaagatacgcgcgccagtgggctttggaatgtcgcggtaccggaggtgatcggaccgcctaaggcgaccagttcaacattgtaggcgggagccatcgcatggtgtgttttattgccatcgccattatggtaggtattatcgattggcatgacattatcgtaagggccagcattcgtttgggttttaatcgcaacgcccacgccggaaatcccggtgctaaataccggcgtgttgttcccgtcattcgcattgattgtcgctgatgtatttgactgcgcgctaccgggttcatataaaaaaccgaccttataatcgcgactacagccatccattgtgacttcggaggtggaaacccagcccgattgccacaacacctcgcctgcggtataggcgtggctatccaccacaagctgcgacggcggggtgatagtgatcgcgccttcattaccggaacgtttacaggaggcgtaactatgaccggaatacgcgaacagcagaataagcgccagatataaccttctcatgaaaaattcctgcttttataccaggtgaaatagaaagatgttattgccatgcaatagtgatcgtcacaacggacgtgaaatcccctgccgtgacttttccgtgcggggtatacatccttgcggcgacaggcaaattggcttcatgggtattactgttgatatccaccgtgtaagtgacgttgttggccagattgaccagacttttaccgtccaggttaaaaagctgtaatcctaaatcctgcgccggattggccgcgctgtttgcataaatcgcagaagcataatttggatcgggataaggtacgccgttaaatgaaatcgcggcttttgtggtcgttgccgggcaattcgtcatttttatggtgaaaggaatggtggcggtattgccaccggccacggcgatatccgcccgggcatattgtccaagagagagcgtgtcggggaccgtcacggtacacggatcggcataaattaatcccgtaacgttaatgcctacggcatctgcggtattgtatgccgcgctgatcgagggcgaccataatgccagacccgtgaacgttaacagggcggctaatgcagcaaatctgttcatattcatcttttatcccaccagaatcactggcattgctcgtgtaagatttctacgccagaagcggagggggagctcggtatacgataagagacctgacactggtctgctgctgttggtccccacttcactaataaccgcccttgtttttccagtccggttaaccaggcctgccccgcatcaccaacaaaactgctgtgattgtctggttttgttaaagacgagacggtcgcgccaaaaggaacaggaagattgtttatgcgggttaataccatcaatgccttgtaaccaatattggttttatattcagccctgaccaccgcgccacgggtaggcaccagcgttttactggtatcaatgagctcaatattttttctaatgcccgtcgtatctaaagagacttcattacgatggtaaggcgaagcataaggtacgacggcataaccccgaaaatcggtgtccacgcccgtttcgttattcacggggacacccgctgcgccaggggctttaaccaatatgatggtgtcgtccattggctgggatagtgtcaggccatttcgatgtaacagtacgccgacctgaacgccataattcaggcgacgcatatgattatcgtagctatatccgccgttaatatccgcatacgtcccgttataggttgcgctcacattaccgctggtggctttctcttgagaggaataaccttcctgaacgctccatgagagatttttctgtgccagcgctgttccgtttaaaccgacagtatgcgtggtatcgccgtctttcgcggagttcatattgtaggtggcatacgttgacggcataaaggcatctaacggaatactaatattgattgaaatttgctggtcattactgtcttccgtatcgtcgtcttcatcctgagaattatcggcgttcagcgtataagaatagttaatgccatagcttacgttatgccatgtgttgttatagccaatacctaatgatgtggtatgagtgtcattccagtaatcttcattatataaagtgagtgaaatggaaccgtagataatgtcttgcgataacgacaggtcggtgcgattgcggacatgatcatagtgactattatcgctataggtatccagcacatcctcaagagcgtagtaatctttggtcgaataacggtagccggcgacagtgaaattggtgcctgttgactgaatatctttgctgtaacgaatacgccaggattgtccggtaagcgtatcgctaaccacatcgcctgctttaatttttgaccatgagttggtgacgtctaaagacaatgcgcccagatcgccaaggtttaagcctgtcccgatgagcgccgcatgataaacatcattgctcagcgtactctctattccgccataggcggttatgccgcctgctaatccgtataaggccgtcagttcagcgaagttctgttgcgcggaatgcgtatctgatgaacgcgtgcggcctaccgtcaggtcgtatttcaggtggccttcacgctgtaataccggaacgctggcgtagggcacaatgaaatgctgttcagaaccatcggattctttgatggtgacgtacaggtcgcccgaaccgccggttggataaagatcgttgatggcgaatggacccgccggaacgttagttttgtagatggtataaccgttttgttcaacggttacctgcgcgctgcttttggccaccccgcgaatgaccggggcgaaccctttcatactgtccggcaacatatcgtcatcagaagagatctgtacgcccttaaatgaaatactgtcaaagacgtccgcgggcgtgttattttccccggcgatcagctgtccttttaaaaattcgatatcgcgagaaacataggtgtaggcagaatcccagctattttgcccatcgctatcatgattccaggttgagtagttacgaaaacgccatgcgccaatgttaataccagggcgcaggttagcgtattcgctattttccgtccggttttcatcaatatcgtgatcctgcgatccggtaaaactgtagttcagcaaaaaagcattaatgccttcatcccattcgctggtagggacgaattctcgcgggtcggcgatcaacgcgatttgagggatcgctaaatccagccggttaccgatgacattaaactttgctacagcgccagccagcagactaagatcggtacacccgtttgggtcatttttaagctcggggaagttttctgtttttacgccccactgcttgagttgttcaacgctaagacacggctgtagggagagcttattatctgctgattttttatttttaaaggcaatattttttgtttcaacactggtgttattaatataaatatcaacattataggtgccttctgcctgcccccccttttcgaaaaccgatagatcgacattctccacgcccggttcatcattttccaacgataatggattaaaatgatcatgcgctaacgctggttttatggaacagcatataaagagaaacgataacgctaattgagaacggggctctactctggagaattgcacagtaaaagtcctgaaagggtaaaagtaaaatgaagtcgttaatggctagaatgaaccggaatgcggctctaaactcatcccataatcgctgattaatcgccacgttaccgtgccatgaggggcggcagtagaacccaatttaaatgacgctgatgattttggcggaacgaaggtcgctgatttcacttcatggctgttaagcgtcacactggcaaagttcatataatagggagtggggttatttacggtaataacatcacctgccgtctgccattttaattgttggctctggctatcaggcgttgattttgttaatgctggcggtcgatatataagctttatttgggtattaatggagatttccacgcggttcgcggaggcattatcatcaatagaaggaatacccttaatattgagccagtacatagactcccgatctgcaggtaggggggcgccagagcgaataacccgaatactgttcttttgcccggcatcaaggcgaaaaagaggcggggtgataataaacgcctgcttatttgtgacctggggatcggcaaccgataaccatgactgaacaagattcgctttgctgtctttattctctacattgattgacgactcatcattattgccgtcgaaaaccagtcgggttccgccaacaacaatgctggcatgggcaacatggcttgtcagtaatacggccaacacggatttctttatgtgtttcattttttactctgtaaagatgttttacgctatggactggcatcctgcctgtccacatcaggatgagaatgccttactgatacgaaacggtatacgtaacctgagtgctaacatctccaccggttacggttgcggaaccatcgtttgccatggcggcgtaataggtaaagtctgctgtcgagccgtcggttggcaggtttactgcggcatcatccgtgttatctgtcacatcgctatgtgaagcgttctgaatagaaataccgacacccgcggcgcccgtttccgatccttcgtccgcgtttttgaagtacgttgggttagaatcatctgttgcgccgtggaagcggaacatggcttgggttggtacgccagtccctgcttccgggcagctaaccaggcttacggtaaacggcacgtaatcggttgtggcgcctttttccgcgatgcgttctttgctgtaattacccaaatcaatggtggtatccgtggagccattcacctgaaccgtacacgcctgatcgtaaattttgccattgaacgtaatcgtgttctgggcaaataccggtgtggatgctacggcagttaacattgccaggatgattattttcttattaaacatattaattgttgcctgattctattcgctgaaaaataaagatagccatataaaataaaatattatattttactctgtatgcgcttctttctgttctgtagataagcaggcggctattctacgtatatcaactatgaactcaataaaaattctgatgcaatattgaacggcagtccagtttcggacccggtaacaaagtttaataaaataccactaaagaagtatggttgatgactggatttatagagcaagatctcttttttgataatagttattatttcctggaggatttatttaactctatattgctttatttttaataatatacgacgcttgtccgtttaaaatgaaaccggcaggtttcgaagctctaacagtcttccatgcagtatttttatatagtcccccgcttttagttctgaaagtacctgcatgatacggctgcgtgaaagcccggttctctgctgtatgaagttctgtgcattgatctcaaatcgtgagctttcaggatacgaccacagttcaagtaacagcgcttttatctggctataggcgtcctgcccgataagatttctgtcacggttagtcatgaaagcaatgcggtacatcaggatgttcgaaatgtcacgccagagatgcttttcatcagctatttccacaaaatcttttactgggacaggataatattcacaggtggtttcggcgataaaaaagacgtctgaattctcttctaactggtataagtcagcataggcatctacaaggcctaaaatcattggtgagacaccgcagcccattacaatgctgtcgatacgccgacatactttaatagcgcctttagtgattaacaggatgtgggattgattatcaatcttgatatccagtgttttaccggctgtaatagtgacaggggagatgttttgaataacgtgccgatgaatatttaaaatggcttgcaggtttttttctttccctgtgggacgatacacattcccgccgtttaactgcttcatatcttccccattattatggctgataaagtggttgactattaaaaggtaaacataaatttaatattcacttaaaattataattaagtaaattaaaatagccaacaagaatatttaagtcaatgtattcaccttatcaatgcatgagcgacaacgctgtttgtaaggttaaccatagtaaatgtgatgattttatttgcaatcattttatgacagctatcataggtaccgtgcttaacgagcgcgtagagcgtacaggatagcgaagcgatgaacatcgctattggaggatacgaatgagagaaaagtacaaaatgcaggcgggcggcgttttactgagcgaaatcgccgcctgccggaactcctcccggcgggagccataagcggttagcggtactggacgatcaggctttgaatctccggatgatcttttaacgacacgtgccgtaccgtggcgattccattcatcaacgaaatagcgtttccagacggtgtggcgactgtctgcaaatgggggatattattccgcaaacatgatacctcgatattgcgatcgtgaggcgcaagattacaaccatattcgacaatctggcctttgaaatgaataacgcctgcggagaccggcgcggtagcagccagcgcggctgatgaagctgacatcgctgcacaaaacaggtagcagcataatggtgattttttcatcctttgaaacctcacgtcctgtgagcatccccttattttttggggactaacaaatcccgtgtattactctttaatgtaaatacacaaactaccttaactttcgcaagctgagataaacagcgctatacgacaatttttatgtaaaagagtacgtcataacggcaggtcaggagggaaagcgaggccgcttagcggaagggggacataagaaacagccagtaagaataacttaccggctgtttttacagtttggcgcctgggccgaattaatcctgcaggtcgccgcagaagcgataaccttcgccgtgaatggtggcgatgatttccggcgtatccggcgtggattcgaaatgcttacgaatacgacgaatggtaacgtcaacagtacggtcatgcggcttcagctcgcggccggtcattttcttcaacagctctgcgcgcgactgaattttgccagggttttcgcagaagtgcagcatcgcgcggaactcgctgcgcggtagtttatactgctcgccgtccgggccgatcagtgaacgactgttgatatctagttcccaaccgttgaacttgtagctttcaacgctacgacgctcttcgctgacggtacccaggttcatggtacgggacagcaggttgcgggcacggatggtcaattcgcgtgggttaaacggtttggtgatgtaatcatccgcgccgatttcgaggccgagaattttgtcgacttcgttatcgcggcccgtcaggaacatcagcgcaacgttagcctgttcacgcagttcacgcgctaacaggagaccgtttttccctggcagattgatatccatgatcaccaggttgatgtcatattcagagaggatctgatgcatttccgcgccatctgtcgcttcgaatacatcatagccttccgcttcgaaaatacttttcaacgtgttgcgtgttaccaactcgtcttcaacgataagaatgtgcggggtctgcatgtttgctacctaaattgccaactaaatcgaaacaggaagtacaaaagtccctgacctgcctgatgcatgtcgcaaattaacatgatcggcgtaacatgactaaagtacgtaattgcgttcttgatgcactttccatcaacgtcaacaacatcattagcttggtcgtgggtactttccctctggacccgacagtgtcaaaaacggctgtcatcctaaccattttaacagcaacataacaggctaagacgtaccggacacctaataaaactacgcttcgttgacatatatcaagttcaattgtagcacgttaacagtttgatgaaatcatcgtagctaaatgctagctttcatcacaaatttgcaatattccaactagttacgtaagccaactaataaatgtgatgaatccaaagaacaggatctattttaaattaaattatcctaaataaacagtaggataacgatgttctgttaacataaacagcaatagtacagatacgcaatagtgtagcgtcttttacgaaatcaaaaatgctttttcagtgatatcagttaaaattttgtaaatttgcgaagcgtaatatgcttacaaacgccagctaatttcctgtaaattagtcaaaaagagtaatgaaatgcgtgtaacaattgttcttgtcgctcccgccagagcggaaaatattggcgcagccgcccgggctatgaagaccatgggatttactgacctgcgtattgtcgacagccaggcgcacctggagcccgccacccgttgggtcgcacatggatctggagatattattgataatattgaggttttccacacccttgccgacgcactccacgatgtggattttaccgtagcgacgacagcccgcagccgggcaaaatttcattactacgcttcgcacgctgaactggttcccttattacaggaaaaatcacgctggatgcgtcatgccgcgctggtttttggccgtgaggattccggtctgaccaatgacgagctggcgctggcggatgtattgaccggcgtgccgatggcggcggattacccttcgctcaatctgggtcaggcggtcatggtgtattgctatcaattagcaggtttaatgcaacagaccacagaatccgttgatattgctgatgaatcgcagttacaggcgttacgcgcgcgccttttacgcctgctaacgactctggaggcggccgatgaccacaaattaaccgactggctacaacagcgaatcggcctgctgggacagcgagatacggtaatgttgcaccgtttggtccatgatattgaaaaaaaactaacaaaataacgtgctgtaatttttaaaataata

SEQ ID NO: 6 - DNA, 93933 bp, Salmonella enterica
gagtgaacggatgaaacagaaagaccgtctgtacggcgtggcaccggccttaccccgattgcaggctgtgaagctaggccgcaggtccgctatgtgtttaagtactggcccacatttgtacagcagtgggaaaactcgctgaaagccgcacagaaggggctggaaatctggaaatcagcgagggcggatgcctggcttgcgtatcacaacggtatttttgccaccagtcattatgaaggcgcgctcaccagtgaagatatcagtagtgcggcggccgccgccctgaaagggcataaaatcaggggtggaaacgtgaacacgaaaagcatactggatggcagtaaccgactggcacatacgcttgcgctgcagggctagccggtgatgataatgatgccggttaaggaggccacggagaagaacgtgacaatgataccgggcggcgcgggacaggaaactctggaaaacgcggccgtgctgattctggccgggatggagcgtaatgatcgtgccaccactagggaaggcaataacaatttatcctgacgcctccgccgctcgcgtcgttgtccagccccggcaatccgggaaaaacgagtttcccccgattccggcgtttctgaagtaataaaatcactactctaatcaagtttatatgaggtacataatgagactcaggaaaggtcatggattgacgttggtcacacttgcgtgtttatccctgctgggctccctgccagctattgcggcaccgtccgttcaggccggtttttcaccggagggcagcgcaagcagctggttcttaagactattgaggctgcgcaacataatatccggctgatggagtattccttcacctctccggaggtggctggcgctcttattagtgcaaaacgtcggggagtggatgtcaggggggggggactggactggaaagccaataccgggaaaaacaataacgccagcagggtgacaatgaacctgctgaccagtgccggcattccggttcgtaccgtcagtgtgtacaaaattcttcatgacaaagtgatcgtcagcgacggtcgccacaccgaagtgggatcgtttaattattcccgtgcagcagaccgttcgaattcggagaacgtgctgtcgtctgggatgactcagtcctagcccgcagctacctgaaccactggacatcccgctgggcgcagggaacggactggaaacagacgtactgacatcccaggaaacgatcctgaaacgtaaaccgtgcgccaacacaggttacgttcataaagtaagtcgctgattttagaaatctgtagtattctctgcaaacgatccaggtttgatccttgaggaggcagagatgtcgcagattgaaaatgcagtaacttcctcatcgaaacgcatttacagaaagggtaatcccttatcttccgctgagaagaagagattatctatttcacgaaaaaagacgacgcataaagagctcaatgttttcatacaaaacatacataaagaaagcttgcagcagctttgtgaagagactggaactactcaggctcaaatgattgagctactaattgaacgggaaatggctaaaagagcctgagataagaaggtgaatgagtaactttcttgatcgtctcgtcagtgagtgttagattgctgatcgtctaaagaattttgatggctggccacgccgtaaggtggcagggaactggttctgatgaggtgtctacccgggaccagaaaagcaaaaaccccgataatcttctcatttcttggcgggaacgaaagattaacggggcctacttaaactgtatagccaccaatcaggctatgcagggagtatagttttatgctcagaaaatttcaatacttgtttctgtggcatttactccttccgtgcattgtaagtgcaggcagaagtgactgacacccgaacactgttcactcattaccgacaggtcaaaaatccgaatccggaattcacgccgagagaagggaaaaagaccctgccgttctgtcgtaagctgatggcgaaagccgaagggttcacgtcccgttttgatttttccgtccatgtggcgttcgttcgttcgctgggaaagcgtcaccggatgccgcctttgctgcgccgtcgtgccatcgatgcgctgcttcaggggttgtgcttccattatgatccactggccaaccgtgtacagagatccatcaccaatctggctatagagtgcggtctggccactgagtcaaaaagtggtaatctgtccatcacccgcgccacacgggcgctgaagtttatggcagagctggggctgattacctaccagaccgagtacgatccgcagattggctgcaacatcccgaccgatatcaccttcacgccggcactgttctccgcgctcgacgtttctgacgtggctgttatggccgcccgccgcagtcgtgtcgaatgggaaaatcagcagcgcaaaaagcagaatctggagccgctggagatggatgaactgatagcgaaagcctggcgatttgtgcgcgaacggttccgcagctaccagtctgaacgtaaactgcacggactgaaacgcgcccgggcgcggcgtgacgcggacagaagccgtaaggacatcgaaacactggtgaaacagcagctgacgcgggaatacgccagcggacgctttaccggcgggcttgatgccatgaagcgggagctgcagcggcgcgtgaaagagcgcatgatgatgtcgcggggcaaaaactacacgcgactgaccatggccaccgtccccatataacccaccagattatgaaaatccggctgacgtcggaggattttgtacgtctgtcgccgggtgccgcctgttttctgcgcggaacgctcgttcttcctgccaaaatatctctcattctgctgccagaatggccagaaatgttcccgcctgagccatttccggtcgcaatattcagttactcacagataactgcaagggacctttccataaagttacaaccgatatactgacaaagcgccaggcgacctgatttcaaagtgcgtggtttcctttaaaccccagatctgtacttcttttaaatacataatctttctctcttataaataaataacctattcatcacctgccctgtggacaggttccagagaatgcccgcccttgcagcggactcacgtccgcgccggttcggaaacaacattagtacctcccgtcgcgacgcgccgggccccggtcatgcaaatagttacaacatccaaaatcctgaccaacgaaaccggagcaaaaacctgatatccagcccattcccaccactgaaaagcgccgccgccccggcccaaagggccggaatggagtcgcttttaataatgaatgatgtaactaaattactgagtggcgttatgtcccgtctggctttgcagggcgatggcccactacgtgaaccatcaccccgccagcagggtattttatatgcagttgtcaaccactgaatcggaacccacgccaaaggcgcgggaccccgcgattcagcagttgacaattttagctaccgtgacgtcatacgttccttttgctccatcccctgaacgtaacaggagccactcagaaccgttttaaacagaaagtaccagcaaagcagaaaaaattgctcagaacgcactacaaactcaattctcatgagtctgccgtggtcgtggtgtcggacctggacggcgggaggaaggtgatgtcgctgcaccggggactctgcggcctgcgaagcgatatcccgcaggcggaggggataacctcagatgaccgggacacgctgtggatagtcagtgaaccgaatctgttttaccgcttcacccgcacggcagcgtcctgaggatgaagcggcgtctccatggcttgaggattggagcctttatgccagaagttacaaccccggattgcagccggatgttatacgacggttttactgttattttgcaataaaactataaaataaatttccgtcaggcttgcatcttgaaggcgtgtatccgtaatatttcctgaactggctgataaaatacggcacactactgtacccgcactgatatgccactttcttgaccgccccctcctgcataacaattaactccgatgcttttttcatcctgcattccagcagaatacgtgtgtaggatgtattctcctctttcagttttttctttaacaggctgacactgacatacagctcgccggcaacccggtgtatggtccagttttcactcacattccggtttatcaccgtagccacctggtctgccatactttgtttcaggcatgtcttcaggaaagggaaaaaaatatcctgctcacaaaaggccgataccagtgcaaacgtcaggaacggattctctggtccggtctctccgtaactgttatccgttccggcacagagtctcaccatcaacggacggaacacagagtcctctgggcaaggctgcacaaggtaccgggggatgtctttcgggatataaaatttaagaacatccacatccagctgccgggcaaaccggcacagcgtttcccttgttatcaccacatgatggtaccaccggtaaaaatgcatctctgtctgatgcactttcgtcaggacaatactgtcctgagcgcaacgaaatgaaaatgcctttccctgattgaaggttgatcctcctgccaggaaaaaaagaagatatttatccagctccattattacctgccattccctcccatgacggggccggtgtttgtactgctctccccccctgaagccccggccgggtgatgccggggcctgtggttgtcagtagtagtgctgcagcagcccgggcatgtaccacaccacaaaccagcttcctgccatcaccacaaaccagaataattccctgaaaaaagatgcgctgaatgttatgtttttcatcatatctgaccgggagcggaagcctgcggctccgctccctttcctgctctccgttatcagaaccggtaaccgacaccaacgttaacgccgttcagtttcgctgcgccaactttacttccctcatagcccagatcgatgaccacattttccaccggattaaactgtacgccggctccccaggcaaaccccgttctgcgctccgaacccgtgaaccgcccgttgtatcccggcatgctgatacgctctttcacttcagccctgccggtaccggcaccggccagtgcatacagagataccagctcgttcacacggacagccggacccgccatcagcgaccagtacgtcgccttcacatcatcacgccagctcattccgccaggaatgccaccggactctccgcgcttacctgactgccaactgaacgacgccatcagtcccagcggcgtctgagcctcatagcggtatttcaggttcaccccacggatatccttaaaatgctctatccggctctgggcatatcccaccgacacggaatgggtgtcagcctgtgccaccggtacggcagccagcccggctgcggacagcagcagtgaggacagaacgatttttttcatgataaaactccctgaacacagttaagttcattgtgttatgacagaaggtgtgctttctgctcctgcacacccgtaacgccgcttcatcctcaggacgctgccgtgcgggtgaagcggtaaaacagattcggttcactgactatccacagcgtgtcccggtcatctgaggttatcccctccgcctgcgggatatcgcttcgcaggccgcagagtccccggtgcagcgacatcactttcctcccgccgtccaggcccgacaccacgaccacggcagactcatgggaaagtacatacaggagcccgttgttccggtcataatgcagaccggagatatccttcaggaaccatggcagggacgcccggtgtgtcagcgagtcactcaccgacagcgcatcagggctccggtccgtcacgtaaagccgcagcggttttttctcctgcgccaccatcagggcatgctctccccgtccccgggcaaggccttcaaaaccggcattgtcgctgtgcctgttcacatccagcgtcaggctgtatgttgccggcgggaggacggtcgtgctgctgtcaatgcagtgggtggtgagcgtccgctcccgctcccgggacagggcatagcggttcccgccgaggtattcgatggcctcaaaatcgtggtcgccgtctgacggtatcacccgcagcacgttcccttccgtgtccagctccaccaccgaggaggggtggtcggtcacggcaaacagcgttctgctgtccgggttccatgtcaggccggagaggccgccgtgtatcccggtaatttctttttctgccgtgagatgccattctgtttcctgcgggtaccaggactccgggaaacacagggtgagcacgccggccgccatcaggagaatggcggtcagcagtgctgctttctgattacataaatatctgaacatcgtggtggtgaaggttatgttttctgttacaggggagaccggactccacatcatgtcccacggctgataagccagatcacgaccaggacgccggtcagaaagccggagataaagacgctggtcagcagcaggagaatcagtgcacggagcgggaggatatctccggcctgtatggtgcctttatcatcagtctgcatcagggttaccggccagcagtttccggaccaccgcagcataacggctcctgaagttttcgacggagaatgcaccgaaggcggcattgttgatatggtaacggccacggacatacacggaaggcgtccccctcacgccatattccttaaacagccgttcctgtaatgccaccatgtcattcacggcgggactttttatacttctgtcatactccccacgactgataccggtggcagacataaacacccggcggacatcgtccggggaatgcaggcgtttctccaccatgccggccgtgaagaaggccttctcgatcacgtcagtttccttcatcaccatggccagcgcccaggcccgtgtcagctcatggccgagggggcccagcaggctgacatggtatttgaccatccggctaccttgcggcagtacgtgccggatggcctggtccacgcccattgtctgtgagaacgcatagcagggcgggcagtaaaaggaaaagaactccaccacagcgggggcatcaaccaccgggggagttatggactcccactcctgcgcaaccacaggacagacgcagccagctaacaaaaaagaaaataatattcccttcagggaaaacagatcccgggcataattcatcgtcacggaaacactccatggataacagatatacagaacgaaaggccgcttaacggcaccgcctgacagcagcagtaaatattaattcatcaggtatggtcattaaggcggcagccggaatattccggttatgcgttttccagaataaaaaatactgacacacaaaagaccattgccattaatataactacggccagacaggcgtaataaataaatttcatgaacatcataaaataactttcagtgatacttatccggcctccggtccgcattccaggccggcttcttccagtgaatgaacccggttcaggtcggtgtacagtgtcaccatccccagaagcatcagggtcggcaacagggttgcatcattccggacgccgaggcgcctgaaagcctggcctttctgggcagaaatggttttgacgctgcgaaaacagagggcagcaatctgcccgctgttatagccccgcagcagcagccggataacccgcagctcagccggactcagtccgccgtcgctgttaaattcgatacaaagccggtcgtaccatatccggctgaaatccccgtcttccgggaaagcggtcagagcagacgccataatccgggaactccctttccggcattcactttctcaagcaccccgacatcgtggagttgctcaagatacaagcggacctggtagatactgagtccggcagcatcggcaatatcgcgggttttaactggcgcgccgtcatccatgttctgacgttcctggacgatggaaataatttttgtaacaatggattcactcataaaccggaattgctctttttatgtaaataaaaacagtctcattaatattcataacacaaggattctaagccaccctctcagccttaagagacatatgatataaatatgtaccagtctgtttgttgcttaatttatcgttgcatctgagctaactaaaccacgtattttgtacatcgttaactaatttacgtctggtaattcgtgttactttttgttctcaccccattagagtcgagacacaactgttacctcatagttatttacgaaattcctcttggtcgcctatagatacgttgaggaaaatgtaatgttattagcgccgggtataacgcagatgctttggcctcagtacaccacgcatggatattttttgtcacctgtcaattatggctatatcgcctgccttgcttatgtggcgtgaagattacgctttattgcagttgcacacttattaacactgtgcccgaacttgtatgtcctggtcgtattgttcctggcgcaagaacaagtttacattcatctccagcacgcattgtcgtgcactgacctccagtagtttttaacaattgtgcatttctggccacttcgctgggagttatcgactgtgttacacgaatagaagcaccaggagtcccactagcctttagtatcacttgctcgaacgcaccatttaccccagccttgctgtttatcgaatctggatgctcaacggtaatactttttgtcgtacctcctgcaggaaagcttgtcgacattacaccattaccgagggtataacgtgctccagatgaagaagtgagtgtgacgctcggtgatggtaagtgatattggtgaagccacgatcccagcgaactggcctcacattcatcatatagggttctagtcgtacggacttctcctgttcggctgagactaaacatcaacgtatagccagcggggagtatatacccttcacccgcaacaatgccattctgaaccaggcccggggcccgaaacattacgccgaaacccttatctgcaaccttgcactcaacttctgcgggatatcgtgttccatcgggtgctataaccatagctgttccattacaggtacgcgatataatttgtacgttgcactgactgaatgaagtcattgttaccatagaaagggctgcttggtctgacttaatcataaagttacttgcctgcatttggtattggtagattccttgactatatgtggatacagttgtggtttttgcatgagcagggtaagtgatgaccgttccccccatgatgatgactgaagcaattagtaattttaacattttatagcccatatttttacgttgttattcactacatagttctttcgtccgatgtttagtcagacccatagtgagttaacctacataatcatttacagagccggtgtcagtcttagccactcggcattcagttgattccggcagcatatcccccatagttcctctggtttcagattggggtacgatgattttctgttgaccgtggtattgcataaacggggttctcttcatcaaacagtagcccagccgtttttactgtgggtaaaccacatcaaaaaccaccgtcacatcaatattcccctccggtgaatttgccggaatatcagtcacagggcggagctcacagttgttcggggagggggatatgcagaaagcatcatcgtccttcccagtcagtttcacccgcttactaccattttccagccagaacagcgggccattatttgacggctgaccgttcatccgcataatgactacgctgctgtcaccgcccccctgcagggttccagtggtgtttcttgctgtcagtgctgtcttcaccacagtactctgcccacaatccactttcacggtaaacggtctgtgttgcatccggactcctttattcattactcccagttgatagttcatcgtattaccgccgttatcaaaggtcagtttgcaggtctgttgcgggttggttaacgtgaatggaatggttatattttccttcgaagccgcttctgtcgccaaagggaacagcagcccagtaaccagcgctcctgcacacacatgacgtttcatccacctgatttcacttcgtctcatcatcctgctctcccggctcacttcagcgtgtagtcctgggtgccgccccagtcgttaacagcctgcaccgtcaccgttccgttcagcgacagtttccccagcgccacctcactcttcggcgccagctgcgcaatctcattcatcaccctgtcgttcagcctgaccggctgcccgttcagtttcaccccggtgaccgcaaagtagtacggcgtcgggttcttcaggtaagcctcaccgccgcggtgcgcaatctgcaggtttttctcggcattacggcgtccctcaacaagcgctttcggccggtaaatcagcttcaccttcgtgttcacggccaccgccaggacattcccttccgacgcctttggcttcggcggaatctcctgaacgttcagccagaacagcgactcacggtctgacggcagcgtgctgtccgtcttcatgatgcggataatctgcttttccttgggcctgaccttaaagaacggcggcgccggtaccatatacaccgtactgctgccctgggtggtgttgtctatccacacctggccgccaaaggtctcatccgcctggttggtcacctcaaatgaggtgttctttctcccttcctcatagataaaacgcgtgccgttcagcacaaaggctgccatggcctgcccgctgacggccagggacagcagggacaccagtccccacttcatcatcttattcacaataaacctcctgaactttgccggtattaggcacaatacctttcactgaaaaatggcagacactgccgtccccccgctcgacgctgacccgtgacggcgcgctcagcatattcatcagcaggacgccgttaccggcaatgaacccggcatccagtccctgctccgtctgcgcgctgcccccgttcaatatccgtccgtcacgctccttcacccgcaggatgtagcgcagcacatgctcggcgccaaactcccggtacacgacagctttttccgtcggcaccacgttaaaggaggtggtctgcagctccaggtcatccggcacgttttccatgtccacgctgacccggttcagggagtaatccgacaggttcaccacggtgtatcccttgctgttggtgggggctgagccgttaatcctcacgcccttcacccccggaatgcgcgccacgcccagcgtgttaccggtttccttcgtcatcatcaggccgctgtctgccgtgcccagaattgtgccgctcacgctgcctgacacggtggtgttatcacgtccctgcgacagcatcatgttggtctggatggcatcaaagccatacgagaggttgccgctcaggctgcggtcgcccttatcactcaggttggtgttcaggccgtagctcaggcggtccgtcggacttgccgacaccccgctgttcatccccatcctgccgctgctgctgtagctcagtccggtactgctgtaatggcgaaccccacccagggtgaacggaatgctaaaggagagcgacgtgctgtagtccggtttgtccaggtacgggcgtttactgtagctgccgttcaggaagaccgacacaccgtccagaatggtggtactgagggaaacatcgcctccgatggcctttcctttcatccaccagtagtcctcctgccagccggccagattcaggttactgttccccaagcgttgcgagaagcgcatctcatagcgtgattttgtgttgtagcgggtataccggtctgtactgtagaagtctgcgaactccacataccccttactctggtaacggtaggccagcaactgcaggtccgagctgtcagagaagcttttggcatacttggcgctgacgctgtgcccgcgtttgttgtctccgttgtcgtatttcgcctgtgacaggttcatcccggcggacacggcgccgaagccgcccagggcctgcgtcacgctcaccccgccggcctggtatttaccgtgcaggatagaagcggcattcagcgtggtggaatcaaagccgtaccccacgcttcccatccagaacatgccgttttcaccgtcagcgaacggttttttcagcttatagttactggacttgcgaccgaccgccacattgtattcaacctccccgggacgcagcagcgtcggcagggtggtgaccggatagacggtggtggttttgtggccggacgcatcctccacggtcaccaccaggtcaccgttccccacggagcggacatcatccagctggtacggaccgggcggcaccacttttgagtacacggcgtacccgttctggctgatggtgacgcgggaggtggagttcgccaccccggtgataagcggggcatacccgcgggcctcccacggcagcatgttactgttggagcgcagtgccgccccgtaaaagccgaaatcagagaacagggcgctgcgggtctgggatttaccgagcagcaggtccccctgcacttggctgatggcggtggacagcgtgatatcccgggcggtgaactcaccggagccgtcagcgtaccgggatgcgctcatgttactggccagcacccagcgtccgaggttgaccatcaggtcggcatttgcataggcactggtgctttgcccggacgtctgcgaggcgttggcggagtacttcaggcgtgccgccggcacgccgtagtcccagcggctggggtccgttttaccgaccaggaacgactggggaatactgaacaccaagctctgggagccatagctgaagtccaccctggtataggggttgcggctgaggacatagcactgcccggcagcattcagcgtggaggcatatccctccaggcggacaggaaccccggcagctttcagccactccggcgacaggcacagggcatttgctgattcttcctgtggcgtaatggacaaacgggctttacccacgttttcctggttaacaatgacgtcgacataatactgtccggccggaaaatccgagccggattttaatacggagggaatggcgctcattccctgcaggaaatccaggttcagctctgagtcagtgctggcaaaagataggtgagaaaataaggcgagactcagcgccgacagtttaaatacccggtgatgaaatgacacaacaacccccctgactcaggcagtccctctccggaggaaattgcacggaaaatacaatttcctgttaaacaggtaataacggaatgcaggatggcgggatgaatatacaggtgctgtcccggcctgcaatcagcgatataaaaataacgaacaaggtaattaaatgcggcgcacggcggtgcgccgcgtcatttaaataaaatatgtaaggttctgcttacgggggattatttgtaagccactgcgaaagatgccacagacttgaagtcaccttcggtcgcaccacctttcagcttggctttgaactgcaggccgtcggtggtcagcttggcaccttcaaagtcaaccgtgctggcgttagcgtttacagcccccgggtttttggagttcacgctttcaaccagtactttggcatcagtagctgtaccgctggttgccccaaagccttcgccatccagggcagcagaagcccaggaaacagtggccgttttctgagccagatttgcacaaccctgtgcattcgggtcaaccggtttcatggcgaagtcaacaaaattacccggctggttagcctgaacggtacccagctgaacaacctggttcggctgagcggcgccgttgacagaagtggtcaggtcacaggttgttgcgcttactgaacccaggaaagttacttcattggcagcgtgtgcagtcccgcccagaacacccagtgcaataatggaagcaataatgctctttttcatgtatataacctcttgaatttaattttttgtctttcacaaaatgaaaatacacattcacattttccagcatggctggcgttattccttcccggacagggcagaaataaagtcagctatgacgtgacatcgtaaaaatcctgagttaccatccgatatatttaataaccaccctgtaaaacaggcgcgcaaatacgcatccgaattaaattcagtgtctgttatctgtttttaatgccaggcggaagctgcccctcagtccgtgaacaacacagacttatgaataataaacaaccatctgcgcagcggcctgactgatgcgtgacaggcggttcaggctggtactgaaatacccgttgttcacttcatagcgttcacagacatcctttctggacacaccaaaaacaaggtagtccctgagtgcctgaataatcttctcactgtgaatggatgatataccgatgagtaaccagaaatgttcctcatttacttttgcaggtatcagcgcccctcttcttattctggccagcatgatttctttgcccaaataataatcagcatcttttctgttcagcatcattggattatctccggctcaatctggtgttgtgacagaaaatttccaaaggaaacaaactttatgccgggaattatatacagatgtttgttttgaaaaagatcatttttgcgatcttttctaccatgcaaacaaaataaatcagaatgtttcaccacaaaatcacaagaaaacaggttaaacgtctatttatcatacataatgcagaataaaagatcgctatagcacaaaaaatcaaaatatctgcaatgcaaatctttttgtacatgaaaagacatatatcaaaaaagaaaaaataaatataaactttcaaaaatataaaaaacagacaaataagcaccagaaaaaacataataaaaataagttcttaacatccgtgaaattattatgtaatgcttcgggctgtgagattatccgagtgtatctttgccttcagaggctttgggcaggacactccgtaagaagatgaaaaaatcacggcgaccttcacgccaaaacagagaagtaatgaccagatctcgtgtattgctctgtaatgtttatgctctccggggttaagagcctccccatgaaagcgctcactggataaaggttatccatactagcaaaaccggatgcaatcaggaaaaaggagcaaatatcctgtcgcttactttcgcttaagatttagttaagatttgttcattaagttttccaggaatttttttcagggaaaacagaaatggaaaaaactttaatcactcttatcattaccactctttctttcagtttgcttgcccggcaaacggacattatttcttccgtagagcaggtatgttcagggaggatttacaggcccggcccccacccagacatcggtttcacaggctaaaaaacagtgggatgatgcgtgggtggtactggaaggcaacattatcaggcaagtcggtcacgagctttatgaattccgtgacagcagcggtactgtttatgtggacatcgataacaaatactggatggggcaaacagcctcgcctgcggataagattcatattaaaggagaagtggatcgaggctgggatggtataaagatagatgtaaaaaacatccaagtgatgaagtgataccggagtttaagaacaagttgtatatgcgggctgcgccgggcaattaaggccagactaactgtatccataaccagtgcgtacgctacgtgaaaaatagccgataaacaacatcatttccttcccctgcaaatttcaccagaacgcgtttcgttgttgccgatcacccgggcgctgtctgaaaaaatacaggcacgacgcgggcacctgccaaaagatgaggtccgtctggtcccgctaacagatataagctatgtcaggcagatggaaggctggatgatcaccacccgttccactggcgcgaacccttgtggaccgccaccgatgaaaccatgcataactgactaaagcaggcagtcaggcgggccgaagctgatggggacatttctcaattccggagacgctgtataccttccggcacagctatatcatgcacatgctctatcacagccggccccggaaagtgattcaggcactggccggtcacaaggagccgcgctcaatggatgtgtatatcagagtgcttgcgctggacatggcggccacactggccgtgccgttcactggtgacaggcatgatgccgcgcagatcctccgaacactcccgccctgacatgacaacgtcactcaccacagcttatataagctgtagtgagcatattacgatatatggagggaaaacgacgggttcacagggctccggcagtaacaggaatgccattctgaaaagtttgtggatcagggatatgcttccggtatgggctgctctcatcactgcttatataagctgtagtgagcagaacactcaccagaggcagtaatataagctgtaataagtaaacagtaatggataactcactacagattatgttcagcgggatttgaagagtttctccaggtcatcaagtgtgatgcccagtttatcaagaagtgcaagtttttcagccatctccggactgacgtcacccggtgtggctggcagttgcgggttctccgcactctcatcatgaggtggctttaacttgggccggcggtagtgaatacagaagagttttgtacgcccacgctggatctcagtgtaatccagatagccaatctcccggagctgctccatggcacgcctcaccgtctggttctgcgagaacacaggggatttcaggttcagacgggcccgtagacgcgccagtgatatcggcgccggatcccgcggcagactctctataaaggtataaagagcctgagcggactcccggcgcttcagggcattgatggccttgagctgcagcagcactttccggtcaaactggtagagttcaaagaggcgcggatcggcttgcagctgaacgatatctttttccgtatcatagtaagccgactgtaccagatgcgtaatgtactctttggtgtgcttctccgttgtgcgggaaaacgagatcacagtacccgcgatacgcttaagtgaaggactgatacgttcccggagcttccgggatgactgactggaggggatcccacagagtttggcgaattcgacaaacgacagctcaactttatcgccaataactttatgccgggcaaaggaatgaatcacccctacccaggtcttgaagtcattatccatatccaggcggggaccagtgatctccactttatcaaacccctcggccctggcgagagacagacgcgtcagttcttccgacgcatcagtacgcgaaagcgtgttctttttacggtttttcagtgacttaagcgtaggaacaaatactccaagccgcatcagagctacaggctgcacggtattactggcattaggagtgagatttacgatttcaccggaggatttatccacctctacaaacaacttttttatgtccagattgtccttgtccagagcgcctccgatcggtggatagtttaagaataaaagcagccactgttttcatgttatagcctgaaaggtgctaaacaacttgcttcagcttatacacagccctgaagaagtttcaggggaacatactcattgtagtttatattactaactcattacagtatatcctttgcataatacagcttattgtttaccagttacagcttatgattaacatgctacagtttaggtgatcatcctccaggcccagtactgacgcggcctttagaagagtcgggatcttcttttgatctaacagggatcgttgtaaggatcttattactggatcgagtgactgtatatgtggataacctgctgaccgacaaggtaattcgtatagtttttcaataatcacttgctgtgactccagtgcgtatctgcttcctttaacttctgtttttttgcgcttccttgccggttcgcgggcttattcccggtcatactcttcctgacttattaattgccagcgaataaggtgaagtcgcatttctcttatctggtgtattgtgaatcctgtacggaccagcagtgttttcaaagctgaggaagtatcttcttcgtatgaagctgctgagagggagaaggcctctggtttttctcgcaaaacatgcagtaaccgcgccagtgtcggcagtaaccggagtgtctccccgggagttacaacggcctgcagatctgtttctgttaggtcggtgagcccctgtttctgaaattcagcatccatctgccggaaccatcattgtggatcagcagttacagtttaattcctcctaacgggaactgaacgagttttatttcaatattcgcgaacaaccgtgggaacctgaaccaggattgctcgttatgaatatgacaaacatgccagctgaaccacttattttccagtcgggtacgcaaagtgcagggttagaacgggttaatatttatttctggattttcaggcaatttatggaatagaaggaattaaccaagcctcttgcgtgccttgtttataccaatcttaagaccgccagaacagacagcgtttccctgcagtcagttggaaaacgttttgaggcatcttttgaaaattaacctgagcctacagcagagaaaatggctcaggtacgtgaactgtatgaattagaagaggccagacgtatgccatatgtgatgtccaaataactcttttaataccggttatatatttacgtttacctgtcccctctcagggacaggtagttgatccagtttgcagacggcgatttctgaatctctttgtgtcatgtaatgacgtcaggaaatccaggactttatcatcgctatccatcgccaagtcatgcaggaacagaaaaaatttcccttcattatctgccagatgcgaatcgagataatgtaataaccagtcagcatgcctcaaaatatgacgttgttcccgttgcagacgctttaacggaaggcgtatcgtcattttatccagtttttgagcctcctgagagagttgctgctgcatgattctcagttctgatttaagcgcctgcgcgggggcgctccggctgaacagtcttttggtaccgagcagtgtatctaccatcattttgtggaccttttggcactgatccatggaagcctgatatttcttaaagtaatagtgggtataaacgcccactccagataatgcaattgagataaatggagcaagtaatgctgtgttcatgaaaatctccttacaagtaggtggaatggccacgtgatgtggacgacggatgaaatataacccactttagcaatttgtgctatcagtttttgcaaaaagtgctaattttaattttgtgtattgatttgttaatgattatgtgatttgcctattttgtgtcttcccctttcacctgagatccgaaaaaaggtagtcccggatcttctttatcctcaccggtgcgccgcgacccggtaacacaagatgtagcggctcagtcatctgctgttgctaccagatgttgtgttataccccttccctgtgacccggcgcgcagggcagaaaagaccgctttgcttattccctgaccgtggtacacttccggaaagtcgtgaatagacaaaaaatcggatcacctgaaaatagccgtcctgtaattccgttacgtttttataagttggattgtaattgcatgtggttaaagtttcattatgaaaaagatgagtgatttactaatagcgtgataacagtatgcgttttaaggattgaaaacatgcatcagtaaaatgcacgagaaaatacatataagagatatgtagataatggcggcgaacagttaactcagtcactataagctggttaacagtattcacaatgcgtggcagatttttgcttcatcggaatgtatacttaattgcatacctgaagtatgtaaaaaagaggtgaatcatgaagcagcgaattacagtgacagtggacagcgacagctatcagctgctcaaggcatacgacgtgaatatctccggtctggtcagtacgaccatgcagaacgaagcccgccgtctgcgagccgaacgctggcaggaagaaaatcgggaaggtatggctgaggtggccagctttatagaggctaacggatcgtttgctgacgacaacaggaactggtgatatgcagtttaaggtttacacctgtaaaagggagagtcgctaccggctgtttgtggacgtgcagagcgacatcattgacacccccggacggcggatggctgtcccgctggtcagcgcccgtctgctgtcggaaaaggttccccgcgatctttacccggtgatgcatatcggggatgagccttaccgcctgctgaccacggatatgaccagtgtgccggccaccgtcatcggggaagaggtggccgatctcagcctccgggagaacgatatcaaaaacgccattaacctgatgttccgggggatctgatatgcgtgtcagcgaacaggtgctgctcagtagtctacgtcagggcggctgtgtgcggagtttctggcgccgctccgccagactggcgggtacgccctctccgatcgttccggacgggcttgtgctggaaacccccggtgaacgcggggataccccactctgtcatgtggattttgcggtggtacagaagtggctggtctgcgaggaaacctggacacagaccctcgggggaacggagttcggcgggacggtctggcgactgcgtactgacagggagaacaccacctcatgacacggtcacgcatctgtccggatactgaatccaccggtctcagtccggcatcggatgccctgccggtcagggagacgacagaacagtttgcacaggtctttttcggaaaatccgtgtccctgctgacgccggaagagcggttcacgacggtgtacgccggctcccgggatatacctgcggatttgcatccggcgagctggtttccggccgacacctggtttcgtaacgaacttcgcgcctgcgcggcctatgtcggacgtcgtcagggctggccactgtatcacgcttcagaagcggaacggctgcgcgcactctatccgctacggctcgccacgcccgcgaccgatccgggaaaacaattgctgacccgtacggcgctgctgaaagcgggttactcacgtgccacgattgcggccatgacaccggtggccgaacggcagaaccgtcacagcggcgactggtatcctttatacagggttcagactgaaaccagagatgactccggggaaaaaacatgatgtcccggaatatttcacttaacggagagaggacatgagtcagccaccgttacctgctgtctgtacgcaggcagcgtccgccctgctgccggtggccattgattacccggcggccctcgcactgcgccagatggcaatgcagcatgacgactacccgaaatatctgctggcaccggaggtaagtgccctgctccactacgtccctgatctgcatcgcaggatgctgctggccactctatggaataccggcgcacggattaacgaggcgctggccctgacacggggagacttttcgctggcaccaccttatccgtttgtgcagctggccactctgaaacagcgggcggaaaaggcggccagaacggcaggacggatgccgtccggcagccagccccaccgcctggtgccgctttctgataaccagtatgtcagcgaactgcagatgatggtggccacgctgaaaatcccgctggagcgtcgtaacagacgtaccggcagaacggaaaaggcgcgcctctgggagatcaccgaccggacggtccgtacctggattggggaggcggttgaggccgcagcggctgacgacgtgacgttctcagtcccggtgacaccccatacattccgccactcctatgcgatgcacatgctgtacgccggcataccgctgaaggtgctgcaggcgctgatgggacacaaatcggtgagctcgacggaagtgtacacgaaagtgtttgcgcttgatgttgccgcacgacaccgggtgcagtttcagatgccgggtgctgatgcagtggctatgctcaaaggaggttcatagagacgtgtatgcatttttcagcctttcgcctgcaacaggccatccggaaccgggagtttacgccgttttatcagcccattgtctgcgccacaggaggggaggtggtgggctgcgaaatgctggcccgctggctgcatccgcagaagggcctgctgagcgccgggaactttattcccgccattgaagccaccggcctcggcggagcgctgctgcgcggactggccgacgaggtctgcggggacgggcaggaccttgcccgcagtgccggccgcaggctgatgatgacgctgaatctcagcctgagcctggttatgacgccgcttttccgtccgcacctgctggccctcagcatccggctggagcaggccggcatgacccccgtctttgaaatcaccgagcgggaagatatccgcgcctttcctcaggcggcggtattccgccagcttgccgccggggggctgcggttcgccgtggacgacttcggcaccggtcatgccggtcccgccagcacggtggctgatcggatgattgcgcgcaccgtcagtctggcccggtgctagggggcccgggtcattgccgaaggtatcgagaccccggcgcaggcggcgcgcctgcgggacgcggggggcgattacctgcagggctggcactgcggcgccccgatgcccttcgggctgtttcatttccggctgacgcaaaaaagccagccggcctttggttaagttatgcgcacaggagtcatttctatgaaccagccgttgttattccggaccgttgccggcaggcagagcaaccatgaagggttttacatgcccccgggcatccgccatctgggcaccctgtccctgtaccgggccgtggcctggtgggggctgtttctgggccgggagtttacccgcgatgacgtcagcgaggcgttcagcattgagccccgccgtgccagcggtatcctcaattacatctgtaaccgtcacaatgacgacgacatttgctttgattcccgcctgcaccccgtgcggggaggccgcgcccagctcgtggtgcgtatccgggcagtggaatcccgcccggacaccatccgccggcagcggacagaccggccgggcgggaaggtgagtgaccggcagtatgaccgccagatggcgcactggctgctgtcccgcccggccggcggtgatacggcaaaactagccgcctggcaggcagcctgcccggtccgggaggcatcatgctgattatcgtcagtgactgtcagtttacccgcctggcgctgacgcgcctgctcgcacatctggaccccgtgaacatgagtgttgcccggtggttacagaccgcgccgccggcaggcagccatgtgctgctggcggcctctcccggcatgctggcatcgctggtcccggcctgccatcacgccaggacatcactgtccctgaaactggcgctgctgggctcaggaggacaggctgtcttcctgaacaccctcggtctcaggccggactgcctgctgccgcgcaccgcctccgcgactcagctgaaggccgcggtcagcagctggctgcgccgtgcgcggggctggcggcaggcgacgacggagagtctctccctgcgcgagcgacaggcgctgtgtgccacgctcgccggcctctccgcgcgcacggcgcccggctcggcatcagccccaaaaccttttacggccatcgccgcagcgcgctgaaccgcctggagctgctggccaatccggtgatcggcctgcctgaccctgcggcgcactacagcatgatgctccacccggggtcgccgccctttttcagcagccggacgaccggcgccggtagccacaacgtttctgcacatcaccccgtgcaccttccggtaacacaccgttctcattatacggacatgacactatgaaattatcctcctgtactccccggcgtggacggggtgtacctgggccacattgtggatgcaggccaccacaccgctggttttaacgctcacgccggccatgacggcccgggcggacatcgcgtcccggatcgggcagagcccgttctctgccgaccgggatgccgccctcgccgggatccggaccgtgccttataccctgaaaaagggggagacggtggcgcaggcgcacggcctgaccgtcccacagctgaaaaaactgaacgggctccgcactttcgcccgcggctttgaccacctgcaggccggcgacgagcttgacgtgccggcggtcccgctgaccggcgggaaaggtgacaataaccgccatgacgcccgcggtccgtttgctgctgaccgggaaaatgaggacgcgcaggcgcagcagatggccggcatggcctcacaggccggcagcttcctcgccagccatccggacggtcaggccgccgccgggatggttaccgtcacttccggccgtctgacatgctcggggcgaacatcttcctcgactatgacctctcccgcgaccacgcccgcgccggcttcggcggagaatactggcgcgacttccttaagctttccgccaacgcctatgtcggcctgaccggctggaaaacctccccggatgtggaggactacgaagagcgtccggccagcggctgggacctgcgtgctgaaggctacctgccgtcgtacccgcagctcggggcgaagatggtgtatgagcagtattacggaaatgaagtgggcctgttcgggaaggatgagcggcagaagaacccgcacgccctgaccgccggggtcagctggactccggtgccgctgctgaagctcagcgcggagcagcgcgccggcaaggccggggagcatgacacccgcttcggggcagaagcgagttaccgcattggtgacagcctgcgcagccagctggatccggatgccgtgggcgccctgcgcagcctggcgggcagccgctacgacctgactgaccgtaacaatgacattatcctcgagtaccgtaagcaggaggtgacgtgccagtaatttcacgatgcaattgtgcttcaatcatcgggattttcgggattctgaccgcaccatccagcacttttaccccaacagcttgccgtgtttgcgcttgaacatagggaagcgggcttttagcttcggattgaagcagttggaaaaggcaacatcgagattgatcaccgcctgttgcaacgcaatagagtcatattcctttagccatgcgtatttacggaatttacggaattttttcgctacagccagaagcggtttaatgtctttacgcggggttaaacttacgccgtgtcgttgataagcgtgtttcttgatatgcagagatttgctgtacacaaaacggactgcaccgaactgggcgttaaggtgctccgcctgttccggtgtcggatatatgcatactttcgtggctcttaacatattcagcgctcattaatatattgtatttattttaacatgttaagtgaaaaattcaattgagtaatcaccacgaatcactggaaggctttcttcgtaaacggcatagtgtaagtaagctggttgtgcattaatctttacgacaaaataccgctgcaagctgtttgacgggcagattatcgctcagttacgtgatgcttttggttcggctgcggcaaagttggagtgcgaaattatcgagatggatggtgaacaagatcacgtccatctgctgatagcgtatccgctaaaactgggggtcagcgtgatggtaaataatttaaagtcggtatcgtcgcggcttctccgtcagcagaatacccacttgcggatgcagagcaaaaccgggctgctgtggtctcgttcttactttgcctgtagcgccggtggtgccacgatagaaacgcttaaagcatacgtgctcagacagaatacgccggagtagcctgccctaaagcccttcgggcttttcgccttatatccccgcccgcattgggcgagggtttacagcggatcttgctaaggctctctattaacttaccattcataaaatgaatatttaaaaaagttatcaatcgtgtttttcatcataagccctgacataaaattcccctgatgatgagaagtgtttttttatttcttgtaagctaggaagtatgttggatgttttccaagaatcaatgaattgtacatatggttttttatcatattcacagataaccacagcgttgaaatcatgtctacattcgccaattattggagctatgtagttctctgcgctaatgataaaagaactttccctcttaatgtcataacggtttaatatttctttttccacctcatcgatggaatttaaacaatatgattggttaagctcatgaccaaaaatgattttatcaacaatggcgctgtctaatcccactgtaggagaggcagtgttcttcgaacttaatatatcctgtcggtgatgtatgttataatgtaaacacgctgataataaaacgcagttcccagagtaatggacgtatgtattatttacatatctagccatttgttttaaattatctcgactcaaattttgtggatacaaaattctctcttttgattcaatacaaagcgcatctttaattctcttgacttcatttgaatcattattattgatattttttgaatttatacgtgatattatatcttgggatgacgcactaccagaaactctcatagttacactacctcaataaaatgcatattacaaaacattaaatataatatttttcaaaaaacgctcttgcttatgtaattttcaccattacagtgcggacatatcaatatgcatgagcgttattcctttacggtgccggaattcgtcagtaaggggggagccttcaatgaaaatttgtaatttattgattaataaattaatgagcatttaaaatagctgtttaacggcgtttactgttccgttgctccccaaacccatacttactctgtcatcaaacgataaaacggttcctcacgtaaagcctgtctctgcatttcgccaccatcacgcccacttcgtagttcattacgataactgagatatttccaattttcaggatgaacgtctgactcaggacactgtcctgaaataaccccattttcggatagtctggattccagacactctataaattgccgtgtcttgtggagaaacgacgcactgtactgcgaattttcctggtctggttttatatacaacgtgaactgagcgcccaggctaacacgggcttgttgaacgaccttctccatatcggtcactttccacttatctaccggactgtcctctgaaaacagcaatccggacagcgcttgaaatgcttgtggcaccatatccctgagcacactgatgtggaacttgtcaccggcaaatttgccctgagactgaggtgattctcgacgagcatggatgaaaacatcgtaaccatggttattcagctgaaaaccttggctcatagcaaagaaaccactctggcgcatccctgaatagtcaggcacatccagcgcctctttaaagtgggataccggcatcttccgcatttggttgtgcaaggagttgaaattatttttcaggtgcttatttgtagatggtatttccgccccatcataagcagctacaatattcaaaggagggatgtttagatttagattaggcctatttatgggcatgggaaatctcctttgcgatatggatatatcgccatattattagatataaattctcagtttttttttaataaaacgattagttatccagaaaacctcattttttatcaggcgaaaaaatgatatttcggtccgttccgagcagaaagttaaagaagggtaatggcaaaagtttagatgcactactttgcgggcctagggtgacggaaaaatctggggttccggagtataaccccttatagagctaggccgctcataccacttctggaatagattcttagtatctatgagttgagtaccctcatgtttattattctttttatcctgtttgtgtcagcagttgcatcatcacttaatctcagcttactaagctggcttgcaaagtcttgggatccacaatttacaatgctttcgattttgagtttagtatttggagggaaaagcatctctgcctctcccttaaaatgtgcaacatctccgagtattctacctttatgtcctttttctaggtatatgttgagaatagtgtcatttatccatgccttatctggcgatgtactcataaaagctttatctattattatattacctatagtagtgtattccttcagcacatccgataatgcgggcttatcaagcttcaggccccggtatacgactctgtgatctgtttcgggaagtgaacttaatccctccgcaatatcatttatataaactgacatggcatttttaaactcctcatcactgggttcatttgtggaaagatagtctctggagagcagagtttcttttgcctgtgtttcaggataatcatccccacgtaaatatttattaatcacactgtacccttgagctgaatagtacctcagagcttgaatctgctttgattcctctacaatcgcccattttgattttggtcgagatgaattacctcccatcatcggaggaggcggtggcggtggcatcatattgttgacaggagctcttctataaccgtcgccttcataggccagcgtccgagcagcgcaaagctgtgtcagtatcggattttcgtcatactccagcagcagacgggaaaccagcgtatcggcttcacccagttcatcaggaaagtggtggaacatcaggacttggcggcacaggcgatggaggcggatctcaaagccgtagttatacagggagaagggatcctggcgggcgagccagctgttctgagcagtgaatgcaggcggtacctgtggatctacaccacgttcgccgtagtcaaacactagggtgaacagccactgtaccgcgggtgtggcgctagtccagaggtacagatcggcggcgggggtcgcgttgccatactgtaccttgctgagatagcgcatggcgctgcgatcgcgtccggcctcgttcccattgaggtccacattgtcaccgttctccgccaagtaggagtaatagatatgctcgccggcaggggtcaccgactcctcaaccagccattgcgccgtatgagaggcggcctgcggatcgctgaggcgtgctgcggcggttttccccagcaggtgcaggatgccgttactgtcatgcagtaaccagaaatcatcgccgttgctgttgcccacccagtactccaggcgataaaaactgctctccgtgcggggctgatagcgggtcaccgtgtagctttgcgggaacgatacgtcaccgtacgcgaagcaggtgacgggattgggggcatcaccggtgctgagcgtttgaaccagcacttctccgtccggccccagaaactcatcgctgtcgttatactgcggcacgccatggctggtgcggcgggcaatgctcattgtcgcgcaggaccagcccacgccgaaggggccattgccgccaccgctgctgtagtgcagcgccagcgcaggcgcaaagccgcgttcggcgctgatgggcagaggcagcgttatactggctaggccgtcagggcctgactgactcagcgccttgcccccttttggcaggaaagggggagtgatcagcgctaaagtggcagatgaaaaaccatttagtatcaacatacactatctcctgaaactggccgtctgacgatggccaggtatattttctgcttacagcgtctgctctacggcctgttcaaaagtgctgccgccgtacagcgcggtagaatgcacctgaacaatgacgtcgctcagattctgcagaatggtctgctgctcactactctggtagcgcgggaagctaaactgccggctggcacgcagagtacccgcaatcaactgttccacctgggggaacggtaatcgctaactgtcgggcaaaggtattcagtgcttcaaatggcgtatagtcggcggttttcagccccagattggtctggtaaaaagaggtcaggtcagtggcggtactgttgtccggctcggtcggcagtgtctgctgctctggtgacagccggctggcgagctccatggcatagttactgttatcgccggtcagcgagttgctcaggaaccacggccagtcaatgctgctctcgctgataatatcttccagcgacacatcggtattcagcagagataactccacctggtcgtgtggaaaatgatacggcagcagggtcggtatttgctggttaatggcatcattaaccaccatcagggtggccaggtccggccgacgctctgcctgtccctgaataccgccgacagcggaactgctcaggttcgtgccattgtccggtgtctgctgcaaggtcccccgaactctgcgggtcaattgattttctcggaacatgcagcggatatactgcgcctggcccatcgccaggtcccaggttttacctccgcgggagcccggccatgacatattggcgttaataaactgtttacgggtctgacggacaatatcaaacacggaataataattatattttgcaaaattccctgccgggacccggatggcggtttcgacctgtgaaagtgccggactggtggtctgattcatattcataaataatgatgactcctgaaaataaacagaatgaaatcctgaagactgataatgtctgcaggggaattattttgtattgccagaaaatgagtggcttatattgagtttatttatgtgctatttttctgctgtgcggaatcgcggttcccggtgtgcaaagatggcacaacaaattaactcaggaataaacaacgttcagcgctccggcgtcgggtcaggccgggaacaacctgaccgctggcgtggtcccatttcaggaattcattcgctgcgccgtcatagtcaccgttattcagtttcttcagtaaagtggcgtgagccagcgcgttaatgcccatgttttaggtaatccaccagagcatcaaactgattctgtgtcagattgacggcgaccagccggtttactccatgctccgcggtgaactaccgctatggaggatggggattgctgacaatctgaatctggcaaatgccgtgaatacaggtgttgcggcccttacgctgcataaggtcagaaggtggactgtttcagttcctgctgtatcagttttatagctttacgataatctggtgtctcccgtttcttggtcgggtaatacaaggaggtacagagcgctacgcctttgatgtgcagtgcgtgatctgttgataatcccagagcccgacagactctgacggggatgagtaacatcgccagcccttgttgtaaccggtacagtgaactgaacaaatcgacgttatcaaaactgaatgcagggttggtaatacctagtgtctgttcaaaaaaatggtatatggtgtccagattaaaatttttagccccctcatgaaaaagtacaggtgttccggccagcctgttgatatcaggtttgccgcagagaaagaattttttaggaataaataacatgaccccaccctccactgatgtccggcagacaagcgattcccgatgaaaataatttctggcagaaataacaatgcagttgtttgtctgacacagttcttctattatttggctgttaacggctctccccattatatttgttttttggccggaaatggtcagtgctgaaatgatcagattttttaaacttcccggataaatttcgtcaaatattatttctagttgtttcgttttacccgtaggtccgatttcctgctccagtgcatgtaagaaaatataatgggattttacttttcgataaatagtttgtgcaaattcggttgggataagagtgccattcttccgtataaagagtctttgtttcagctctctttccaggtctgaaataaccctgctcagcggggttcgggtgatatacagtactgatgttgcgatactgaaggaacctgtttccatcagtgttatgaaaatttttaattttttattaatcaagaaatccataatatctccttttttttttcagaataatcctgaaaaaatgttttgatgtgcaaaaacaggatggcggtgacctgtttttgcacagactgattagttcttactaatcatggggttactggataggattatgggcgatagattttatgcataccctgactttatttctgagtggatttaattgacctgttatgatgtatagctggataacaacgatgtatacccatgatcaatgaagatgcttggtttcaaaaataatcaggatcatgctgatggctatgaatgttgagttgaccgcagaacaaaaaatcgctcttgaagcattacaacgaaaaagtcgcgatcccataaatgaacagaaccgatgtacgaccgggccggaattaaacgggaggcgttattaggcctggcgcactacaggacagaatgcagagcctttttataggttcagtcgaacgaaaactcacgccaggcgagaaaggttgtctgaaaaatcgattagtgtgcactaaatagcttcgcaaaatagtagatcactgaaagggaactcagcccggattgtgcgatctgatcaatcgccaaacatcacaaatcaccaaccggactgagcgatgccgatcatagcagcaattcctgatgaagaacgacaactgatgcgcaaagaggcccaacaaacccacgataaaaaccatgcgcgacggcttatcgccatgctgatgctgcatcagggaatgaccgtcactgacgttgccagattactctgtgccgcccgttcatccgttggtcgatggataaactggtttactttacatggtgttgaaggactaaaaagcctcagacccggacgtgctccacgctggccggtcgctgatatccttcagctcttgccactattggtacagcgttccccgaaggattttggctggctgcgctcacgctggagcacggagcttctggcactcgtcatcaaccgactttttgatgtgacgctgcaccgctccaccctgcaccgatatctgaggcaggcagatatggtctggcgcagggcagcgccaacgctgaaaatcaaagatccgcactatgaagaaaaacggcttgtcattgatcaggcgctggctcaggagcagactgcacatcctgtgttttatcaggatgaagtcgacatcgacctgaacccaaaaattggcgctgactggatgcccaaagggcaacagaaacgcatcgccacgccgggacagaaccagaagcattatctggcaggcgcactgcattcaggtacgggacgggttcactacgtcagtggcagcagcaagagttctgatttatttatcagtctgttagaaacgttacgccgtacatacaggcgggcgaaaaccatcacactggtggcggataactacatcatccataaaagccgcaaagtggaacgctggctggaagaaaacccgaagttccggttgctgttcctgccgatgtattcgccgtggctgaatccgatagagcgactgtggttgtcgttacacgaaaccataacgagaaatcatcagtgtcggtacatgtggcagttactgaaacaggtagcacaatttatgaatgccgcttcactgtttcccggcaatcaacagggtctggctaaagtggagcggtaatatgcgaagctatttgtagcggctcgcaatcgaaatccccccgactcgcaatcagcgccaattttggctcacattaactgcaaatgaaaaacgccaccggctcacattaggtgataatgggctcgcatttatcctgcccggctcgcaatccattccaccgggctcacaataactgcaaatcaacatcgtcatattggcagaccgaccgccagcattctgtcgcgtagttcggccgtgcgggcagggtctaactgattattaaataatgccctgatttcagctggttttgcatcgaactgctccaccatatccttcagccggtaaccatgtcgcgtgagcgtcggctccaggtcatccagctgacgtgacagcacggattcaaccagagtggcagtaatcggtttttcgcccgtctggtatcctgcttccatcgccagcgtcaggtgcaactggacctgcagcggtgttcgcagtttcatcgccagcaggtcaacggcttcggtcgttagaatatcttccggcttacccttaccggtgctggtcttcagcagccactggatatattcacgctgactgccggtgatcccgtccagtgtaaaaatatcggtacgatagccaatttcctccatcgtcggacgacgcaggtcattacgcagttttgggtgaccggccagaacgacggacagcctaccaccgccgtcttcaaccacttccatcagccgtttgagccccgttagtgtattaccgttcaggtcatgggcttcatcaacaaacagcgccaccgggcgtttgccttttttgaccagttcctgcagctcacgctcgcggcgttcaccttgtttgtggatctgcacctgtttatcctgtgccaggtcataaaacagggcattaatcagcgtggcgagccggacactctgtttgtccaccgacagggagcgggcgacaatgattttattttcatccagcagttgctgctgcaggcgtcgcagagtgacggttttaccgcttcccaccacgccacagaccgctatcagtcgtccttcgcgtatcgcacccttaatgtctttcatcagctgcttatggtgggcagtttcataatacccggcctgttcaatagactgcgtcagtccataatgctccatcacttcaacccgcatggtcctctcctgattgtctgctacgaaaatagtctctgatgcgggcgagtacttcactacggttaagcgtctcagtcagaatactgtcgataaacgcccggtcttcatccgacattctggccagcggtatggccagatcgtcggcaattgccagttttgccgcaataacggtgggaaagtggtattcaaattttcgggtatcaaagggctgatgtggcaacgcatcaatgcgctgctgagtgtcatcactgaccacgcggagatcgctgccggacaatgcgctgatggggatgttcagctgcctggccagagcatggatacgatcggcccgttcagccgctttaccgcgtctgaacgtccggtaacggtgcagcggcacaggccccgacaccggataataaggcccccatgtttcaccggtaaactccacatacatctcttcgtcaaacagcccccacagcagaatgacggtttcacccgccatatccggttcaacttcccatgcggtgccgtctatcgttatccgcgcatcaacacccaccttgcgggattccggctcccgggcgaaccgacagtattgttcccagctgcacatatccctcacaccttcctggccgatatttgccagccagtcctccagtcgggagtgtttctcgctgcggtgacgctgcgcgttataacggctcagatagttccagagccattcgttggcctgcagctccgtttccggtttatggaaatggtacagagtttcatgtgcctccttgacggtccggaaaggacgttcaactttacctttggaccgtgccgtcgtccgggtgccgtccttgcctgccggcgtatgcgtcagccagtcaaccttcagggactgcatcacattctggaatacatggtttttggccaccggtccattatcgaggtacagcaatttcgggcggccctgaaaaggaaaatcagacctggtttttggggccatggcgttaaagagaaaacgcagcgcagattccgcatcctcaccgtacacacaccggtattcctggtatgcgacaccgctccggtcatccactacgctgaacagcatcagcgtgggttcgccccgggcaggatctacccagtcaggccgctcaatatgtttgagatcggatggcgacatatcaaactgccaacagtcattgctgttttcagcctgaaatcttaccgccggaggctcccgtaacaggcggggctggtcgagacgccagcgggaaagccagcgattgacggtctgcttacgaagtaagcctttgggacttttaatcaatccctggaccgtctccacgccatgctcttccagcagctgtattgcccgtccggtcgacagatggcggccggatttatttgtggttcgtaatttcagtgcagcaatcagttcgcagtaatgctccagctcggacggtggcagtatccggggttgaccatgatcactgcggtgggccgttcgcggtttcaaaacaaggtgaagagcgcgataaaccgtcgtgactgaaataccatacagctgggcggtagcggcaatctgattggcacgttcagggctttttggcggcaggcgatcgagccgttgccgtagttgcaacagggagtcagacggaatcgcgctacgccggctgctcataattttccagcgcccggtagactgacgccctcccaatcccgagctggcgggcgatggctgtggctcccatcttctcaatggtatacagacgatataccacagcaggatctatggacggtttccttccccggtatacgcccctggctttcgccgcggcaatgccttccatctggcgttcacgtctcagattggtttcaaactcagcgaaaacacccagcatatcgaggaaggctttgcctgcagctgaacgcgtgtccactggctgttctgttgccctgagcgttacgccctgttgattcagggcatacacaatgtcctgcaggtccttaatgctgcgggccaggcgatccacgcgtgtcaccatcaacgtatcaccagggcgcaggaactccagcagcagctgcaactcgctccttccggtccggccgcttccgctggctttttctgcacgaataatttcacaaccagcagcgcggagaatttgtgtctgcagagtaagatcctgatcgctggttgaaacgcgggcatagccgtaaagtgccataatggtgaaaactgtctcgtttaactctagatgatgaaaacgtaacaccggaatgggataaaaacaacccaaatgagacagaaaaactgtctcaccagactgtgcgttttgggtgtactcaaaaaatacattttcattccagagaaaatttaatgagctcttaatgtaatgcgaggctgactgtattcggactcggactgcttcagttatacttcgaaaaactcaaccttaccgccagtaaggtgatacatactgccaacgattttaattttcttctcatcttccagttgtttcagcaccgggctgtttttgcggatgttttcgatagtcagctcgacattttttcgtgccaccgcatcgacaaaatcataattgctacctttacgctcaccgctatactccgtttttgcaatcgcgggtttaatttcatccagcagccccgtcaggttacccagttcagcattatcaatagcacagcgtactgcgccacagcgggtgtgtcctataaccagcactactttcgcgccggcaactgcacaggcaaactccatgctgcccagcatatcgcgattactgatattacccgctacgcgggaattaaacgtctcaccgatccccgcatccagcacaatttccgccggcgcacgtgagtcaatgcagctaaggatcaccgcagcaggatactgacccgcaatactgttgcgcttctgtgccaggtaatcatgtttagccgggcgattttcccggaagcgcaggttaccctgtttaaaatgttcaatgactgcatctggagtcataccgtcacgttcctctttgctcagtgatgcggcgaaagagatagttggtaccgataaggccgccagcccggtgacagacaaagcagatactgcaagagtttgtttcagtattgcacgtcgtgaaggttgtgctggttggttttgttccattatttgctcctatttactgagttaactccaattgctgcgattatacgtaggtaaacgttaatcaaaccaaaacgacaatttttaaccagtatgaataaatatctgagaccagtcgaactggaaaatagaatgctggcagtcggtttgccgatatgacgaagttgacttgcagttattgtgagcccggtggaatggattgcgagccgggcaggataaatgcgagcccattgtcacttaatgtgagccggtggcatttttcatttgcagttaatgtgagccgaaatttgcgctgattgcgagtcggggggatttcgattgcgagccgctacaactaggaactctgtgtgttccgaacttcataagtctggagcgttcatctcattctttgagtgtccgtttggtaattccggttgtcgcgtcacagttatgatacggagaaatcaggtgtggctctcagtctggtctggcttgaacgtggccatcccagagccagtgctgttgctgatgtactttcagccgcaggctttcctgatttcgggaagtagctccagcaactggccaaagaaccttcgcaacgttgaataagcctgatttattttcactgacttatgtgattaatgctaatgtacgcatacattagcattaatcatgcatttaatcccctgcgcctttctgtctgttctgatttttctggtagtcctgcttcactctcccgatattcttcagaactgtctgccagtggtcctctgcctgctgccggtagcgttcggcaacggcagcaataatgtcaggatcactgtcatggctgcggtgcatgcgtcccttctggccaaagatatcaacaataatattctggctgccctgcctgtcgaaaagatgagcgcacaggcgctttacaaccagcggagtatagtccagcccggcctcatcagcgatctggaagaagaagtacagcatctcatacgttttgtagcgcttgacggccgcactgagtctggctgcccgttgtggtgcttcccaggtgtcatccctgtagttacacagttctgcctggtagtcggattccaggtcttcctctgtataccggtggtggcggaaaaagtattccctggcccgtttgacgactgattcatcctgcggcatgtctgtctctggttaatgctaacgtatgcgtacattagcattaacaccagtacctggcaaggagagtggcgtgcatcgtacctgtggtgcatcccgcccgggctccggacatgctgtgccagcaattcgaccggcggtgcgctgtcctggtgccctttttcgctaccctgtcacgtctttaatttgtttgttagttagtttatttgttggtttgtttgtgtataatataagcatacccctttatgcggagactgacagatgcgtccggcgacatacgaaccagaacagattattgaagcagggctggccctgcaggctgaaggacggaatatcaccgggttcgcactacgtaaccaggtgggtggcggcaatccgacacgtctccgccagatatgggacgaataccaggcttcacagagcacggtcgtcactgaacccgttgccgagctgccagtggaagtggctgaagaagtgaaggccgtctccgccgcgctgtccgaacgcatcacccagctggcgacagaactgaatgacaaggcggtccgggctgcagaacgccgggttgcggaagtcacgcgtgctgccggtgaacagaccgcacaggcagagcgggagctggccgacgccgcgcagacagtcgacgacctggaagaaaaactggatgaactgcaggacagatatgacagtttgacgctggcgctggagtcagaacgttcactgcgtcagcagcatgatgtggagatggcccagctgaaagagcgtcttgcggccgctgaagagaatacccgtcagcgagaggaacggtatcaggagcagaagacagtgctgcaggatgcgcttaatgcggagcaggcacagcacaaaaacacgcgggaagacctgcagaaacgactggagcaaatttctgccgaagctaatgcgcgtacagaagaactgaagtctgaacgcgataaagtcaatactctccttacccgccttgaatcgcaggaaaatgcgctggcctcagaacgtcagcagcatctggccacccgcgaaacgctgcagcaacgcctcgagcaggccatcgctgacacgcaggcgcgcgccggtgagattgcacttgaacgtgacagagtcagcagcctcaccgcaaggctggaatcgcaggaaaaggcctcctcggagcaactggtgcgtatgggcagtgaaatagccagtctgacagagcgttgcacacagctggaaaaccagcgtgatgatgcccgtctggagacgatgggggagaaagaaacggtcgcggcactgcgtggtgaggctgaagccctgaagcgtcagaaccagtcactgatggcggcgctttcaggcaataaacagaccggtggccagaatgcgtgatgatgacaattcagacgcctgtgatgaagcgccccgggcggaggataaatgctacaccaaagggcggcttcgggatgagttcaggatgaagccagcccctggtgcggaaccggtcagaatgtacaaaagtccttacggcgggaaatacggcgtatggcggctggctgactgcgtcccgatgcgggcgaaacgccctcagacagaaaaacagcggctggccagcacacgtctgggcctgcaggcccggatgaagagtgagcgtggcaggttcgccatgctggcacatacctggttagcactgggccccgtcttcctcgataccgaaacgaccggacttgatgccggcgcgcaggcgctggaaatcggtctggtgaatgcccgcggtgagaggatatttgagacccgcctgaaacccacagtcggcatcgatccggcagcagctgcagtacaaatcgttacggaaccatatcgctttccggtgctgtcagtcaggctggcctgagctggatcggggtggctcattccgccgtcactgacgccgttatgacagcacaggtggtaaacaatattgccggatactggcatgaactccagtgtgaaatgaatgatgacgcagggagtgagccagcataacgctgctctctggctggtcagacagttgcagggattaattcaggagtctgaaatggagaatatgttgaaaactatgcgtgagcatttccccgttcgaacagtggtgatcgaacagtctctggatatgtttggtgtcaaacgaaatgaggacgggacgttactcttcccccgtcactccgataaacgttttcccgttgcacgtatccgtaagcgactggcggcttatggctggcgaggagaacgcctgaataaggaggtggcgcgaatcgtcgcgggccctgatatcctccctgagaggagggactacagcattattttcccttacggatgggagaagaagcagctgacgcgtgagatgcggcgaatgtttctccgtaagacgggctgacgtgtgctgattatgcctgatgaattacatcatttttctgacttgcgggagaagccgtgacattgacagaaaaatcaggtcatctggcgtggtgtgccctggtggcgcttgcgctggccaggcaggatggtggcgttctctcgccggcacaggaaaacctctttctcacccgctggctggcgactgcgctgaagcaacggcgtttttctcgtgatgtgacgcccgatatcgagtggcttttgaaacagggacgtcagatgggcgtcagcgccaagctggccagcaagctgaattacctctggcgttcatgcaccggtgagttgtccgagcagaacgacctgttccggctgacgtatgctctggaaacagcgaaagatatgcactggaactaccgtctgctgagcgatcgggaatggtccggccggaatgctgtggcgctcagtgcaggcgtgaacggcatttatctctcacgggccaaactcgatgtcggttttaacgacagcggccgacagataaattcgctgacagcacgtttgacagggaacgtagcgggggtaatgaagctgtttgatcgctgtggctggcagagcctgatgcctccctgccccaccagtattcgctgatggccgggcagggagtgccagaaaagggggattagtggcggatctgcgctaggtcgtcttcagtcagaccggtcattttcatgacggtattgcggtcaatgcagttctggagcatggtacgggctattttcagagtcgcttcgcgctccccttctgaacggcctttttcgataccacgttgttcaccgagctgaatccccttctcgatgcccttctgttcgagctgttgtgcgatggtcataagtgcgtctccgtgttgcggcacacgctgtgccagttcgcgtacaaaggcttcggcgtccgatgtttcgcctgcctgcactatatagtgtaccagcgatattacctgcgatgaagacagatatccggccagcaaaatgggcgccagccggtcaaccaattctgccaggtcccgctgatgaatatgtttctgcaataaagtcagggcggccatgctacggtggccggcgatttcatcatccggaatgaccgtaacgtctaccagcgggaaagcactgctgtagagtttgtctgccagagccgtatcgtcaaattcgtccagccagcgggtggagtatggatacgggctgcgtttccccgtatagaacaacactggtatcaccagtggcagttttttatgccctgcctccaggtggcgctgcatggcggccaccgcatagcgtatcaggcggaaagccatatgtttgtcaggtgttgactggtgttcaaccaggacatgaatatatccgtcgccggctgtggttttcaggctgtagaggacgtcgctgaaatactggcggagatcatcctcaacaaacgagccggattccagtttcagtgtactgagatcgcagatggcacgcagctctgccggcagatgcagctccataaaatcccgggcaatgtcaggttgtgtcagaaactgccggaatgtcgcgtcgtggggagtcggcgtagtgtttttctttttcatcagtccatgctctgaaaaatgacccggtcatagtatcacaggcaaaaaatgttgacattgcgaggaacggaattgcaattccttcaggggcagtcccctctttcttttttaatcatcagcttgcttgcccggagatatccatgtcctggcagaaactggtactgctgaactataccctaatgtgcctggctgacgcgccccttgggcttgtccaacccttcgcctgctcagatgcaagctctgaacagactcacggtttgcgctgtgggttaacaaaatgattgtggatgtagtgccctcttctccatttaatcttcggtgcctcctgtgagagcaaaatcaaaatattatgatttatttcttgcaacatgattctttttgttcaaaatgacaaaaaacatcatgaggtgataaatggaaaatattgagcagttacggaaagtcgccacacgtgcaggtaaacttctgacatccttgagcgaaagtatccgccagcaaaaagaggaattgaagcttaccgagttctatcaggaatacagcaaagccgccctatataagctgcctaagctcagcaaagggagtgttgagtatgctgtggccgaaatggaagccagtggctacatttttaaaaagaaaccttctggcaataccatgaagtacgcgatgacgattcagaacgttatcgatctgtatttccatcgtaaagtgcccaagtacagagatcgcttcgataaagctttcactatatttgtatgtaaccttaaaggtggcggttccaagacagtttctaccgcttcattatcccatgcatttcgggctcatcctcagcttctgttcgaagacctgcgtatcctggccatcgatttcgatccgcaggcatctctgacaatgttcctgagccatgagaattcagtgggcctggttgaaaatacggctgctcaggccatgctccagaacgtgtctcgtgaagaattactttccgatttcatcgtgtcgtcaattatcccgggcgttgatgttattcccgcttccattgacgatgcattccttgctgaaggctggaagggattgtgtgaggaacatctgccagggcaaaatattcatgcagtgcttaaagagaacattatcgacaagctccggtatgactacgactttatcttccttgatagtggtcctcacctcgatgcgttcctgaaaaactgcatcggagcggcagacctgatgttgactccacttcctccggcaacggttgattttcattcttccctgaagtttgtagccagccttcctgcgcttattgattcgatcgaacaggatggacacacctgcaatctcatcgggaatgtaggttttatgtccaaaatcctgaacaagtctgatcacaaaatttgccatagtcaggccaaagaagtattcggtgccgatatgctcgacatggttctgccgaggctggatggcttcgagcgatgcggggagacttttgacacagttatttccgcaaatccagcaacctatgatggaagcaccgaggcgcttaaaagcgcaaaatcagcagcggaagactttgcgaaggccgtatttgatcgcattgagttcattcgtactaatggaggtatgtgatgtcgaatgagagaagaaaaactattggcagacagttaaatacccaggcgtcaatggttgagatgactgacacccaaagaagtcaggtatttaccctaaaaaccggcaggaagataacgttcaggtttgttcgggtacctgcatcggacgttgaaagtaagacattcgtaaaccaggaaaccaacggaagagatcaacttgctctgaccagggagtccctgaaatctattatccagacgattaagtttcagcagttcttcccctgtattggcattcagcaaggtgaaaggattgagatactggatggttcaagacggcgagcctcagcgatttatatccgtacaggccttgatgtaatggttaccaatgaacttttatcagctgatgaagctcgccatctggctaaagatatccagacagctaaagagcataaccttcgggagatcggcttaagattgatggctctgaaagagtctggattcaatcaaaaggaaattgctgaactggaggggttatcccaggctaaggtcaccagggcactgcaggcggcagcagtaccgcaagaattgatttctctgttcccggttcagtctgagctgtcgtttagtgactataaaattctgttagaggttaatgaaaaactcagtgaaaagggtttaacgtctgaagggctcattcagtctgtctcagatcagcatgatgcaattttgagtgactacgagcgaccagacgacgaacagaaatccagtatactgaaattgatttctcaggcctctcaggcattgatagctccgcctcctaaggaaaagtcagtaatttccgcactctggacctttgaagaaaaggacaagttcgcgcgcaagcgtgtgaaagggcgtacgctaacttatgagtttagtcgtatgtcaaaagtggttcaggatgaactggacaaagctatcaacgaggtccttgagagaaatttgagtcaataatttcgccacggcgatttcacatctaacttattgtaattaagtaatttatattgagaatttcaaggtgaaatcgccacaatttcaagtcaatttcgctgcaggaatatctgcccaacgtgtcgtataagctggcgaaagtagttcccttttcatctgccactcgggggcaatcccccgaccggcgaaccatattttccccttgcccggatggttaatcccatccaggacttgcatcagctgctcgctccgttcccgcggctgtacttcatcaaacaaattaagctgcgataccccggttggcgtgaaatcgttcagcatacagcctgcctttgcgtaacggtgaccatccacccagatcctgtccagagctctgacggcagcggcaatgatgtcccgtgtatcctgcgtggggatgagcagtttttcactggccagattaccgtagtagggctcagttacggcgaacggcgatgttttcacaaacacggcaatatgcctgcagaactgccgttccccacgcagcttttcggcggcacgttcagcgtgctgacagactgcctgccgcatcgcttcataagtcgtgactcgttctccaaagcttctgctgcagactatctgctgtttggggggcggtgcttcctccagggaaatacagctttctccattgagttcccggaccgttctctccagaaccacattaaagtttttcctgatgaacgttggattcgcgcgggccagctgcagtgctgtggtgatccccattgtgttcagcttctttgagatcctgcggcccacaccccagatttcctccaccggttgcagtgacagcagtttctccgttcgtttctgattgtgtaacgtcagggcaagcacgcctccgaactgtgaccattctttcgatgcccattgcgcgcttttagccagcgttttggtcggtcccattccgacgccgatggtcagccctgtgccggaacgaacgtgctcacgcagctgtcggccgaaatcctcgaaatcgatgcaactgtctataccgcgaatatccagaaacatctcgtcaatggagtactgctcaacgcgtggcgccagctcttccaggtgaaccatgaccctgttcgacattgatgcgtagagggcgtaattactggagaacgcgataaccggctccggaaatttcgccgacctcagttgaaaccacggcacccccatttttatgcccagtttttttgcttcagcgctgcgcgcgattacacaaccatcgttgttactcaggaccaccacagacctgtcacgcaaatcggggcgaaagaccttttcgcaactggcatagaacgagttgacgtcagccaaagcgaacatcagtctgtgctccgggttttgtgtataaaagccgtcaccaccccgaaaatctgcagttcttccggataaagcgtggggtaggccggattaatcggcagcagggcgatacggggcttcaactgcaggcgcttaacggtgaactcgccatctgtttccgcgatgacaatatccccctgcatgggtttctcagctttgtcgacaaccattaaatcgccggaatgcagacccatttctttcatcgaatccccgatagccctgacgaagaatgttgcagccggacgccgtatacagtaggcattcagatccagttcctcctctgtgtaatcggcggccggcgacggaaaccccgccgggcaacgttcggtgaacagcggggcagtggactgtaccggctcctgttcgggtgctacaagcagtaacatggcatacctcttaaaatgcctgtttttatatacagcattatttaagatattttctgtcctgcaagtgaaattttactgtttcccctcagataactgttctgcctggaaaaacagatgtcaggttatccacagaatcagttaataaccctgtggaggagcaacgcagaactgttggtatgtcatctgtcctcctctggtgtttcccttcagctcctgttgtcaccccggccattcctgcacacctgatgctgactgccacccgctgccagtgtgccgcgtccggcctgtcacgggacgggcgctggcgtcgttgtgattgtactccataccctcgccagtttaagggcgcccttcaagccgctttcgcggcataagctcgccgacgatgagaattgtcggctcgttattccacggtcggcgttgacccgttaccggacgcgacgaacaggcagcgtgcggcagggaacggtatcgcggtgatgcctcctgccggatgttgaggaaaatcttatgttcagagtgacctgtatcgacctggaaaatggcgagtttgcgctttatatcaacggacattatctgtccagtgaagacggcagcggcgagaagctgtacctgggggatattctggaacgtttatcccgtctgcctggtgtgaccacggaaaccgtggagcgaccagtaccagacagtgatgagtggagctggaacgatgtggcagacagtgtttttccggcctgtatcacgctgtcccgcaatatgacagtcgctgcgtttaaacagcgtctttcccggtttcctgatgatgcgctgtgctgcggtacgttctggctggccagtgattttctggcgctggacagttcgctcacggaagacgatatcgatgcggcgatggagctggcacagcactgccatgatgcgaatgacgggttcaactggagccatctgcaatgggcaatcgatgaggtgaagcgcggtggataataattcaaacattaatgatacctggcttgttggcctgagtgtcgacgtcaatggcactgaaatgatggtgcattacctggtttccgcgactgacctggagcatgccgaagcgggtgttctgcaaatggggcgcacctggtggccatcgttgaaacgcgaggatgaccggcatcggtgggaatatgaaacaggcgtggtctggtttaacagcatcattctgctcgatgacgtggaaaacagtatcctgcgtggtctgaagttcctcgatgcgtggacagtgaccggctcaacggatgcgccggtactgcgcgatgagtgggggaatgactggcgggatatcacccgctgataatctgccgggcagtacgtctgcctggtacttcctgaatgaataatgatgtcgcgcagctcctcttttttcggcgccagcgccggcggcgcgggagcaacgctgcctgtggtcagtatcccgcgtccggccgggcacgggacgggcgatttttctgctcctgccgggcgctgtcgctattatgcgcccggcactcgccttctgatgaacgcccttcaagccgctttcgcggcataaactcaccgacggtgaggactgtcggctcgttattccacggtcggcctgacccgttaccggacgcggtgaacagcccacaggcagcggggaacgggcgtcacagggacgccctcccggtgcctcctgtaaccgcgaggaatctctatgtcccgtttaatcctggggaactgtgtcgatattatgtccggctttccggagcgcgccgtcgatttcattctgaccgacccgccttaccttgtcggattccgtgaccgttccggccgcagtattgccggtgacagaaccgacgagtggctgcaacccgcctgtaaccagatgtaccgcgtactcaaaaaagatgcgctgctggtcagtttctacggctggaaccgcgtggaccgtttcatggcggcctggaaaagtgccggtttcagcgtggtcggacacctggtattcaccaaaaactactcgtcaaaatccgcgtatgtcggctaccgccatgaatgcgcttacgtgctggcgaaaggccgtccggccctgccacagaacccgctgccggatgtcctcggctggaagtattccggcaatcgccaccacccgacggaaaagcccgttaccagcctgcaaccgctgattgagtctttcacacacacgaacgccattgttctcgacccgtttgccggctccgcctccacctgcgttgccgcgttacaggcggggcgcagatatatcggtatcgagctgatggagcagtaccacaaagccgggattgagcgcctgacagccgtacagcgcgccatgcaacgcccggccgccaacgacgtcttttatccggaggccgcgtaatgaactattccggacacgaaaaactccgcgcagaagtggcggcgctggccaacagcatgtgcgacctgcgcgccaccctgaaagtgctggaagagcgttatcactggcagcgtcacggacttactgaacgactggccgggcagagtctgcggcgtatcaacaccctgctggatgaagcgtacaacgaaagcctgatgctcaatgagtgttttaaagactgacagatgacgagaccacgggcggcggtgccgccccactgaaccaacggagaaaatcatgatgtatggcacacgtaaagaactgaactcaaagctgaaacgcatgtttggcaacgacgagcgttttgccctgctgatctggacgaagcaggacgttatgtcactgactcaggcgatgaccgaagtggaggccgatgcgattttgcgtgagattggccgaaaaggtatgggcgaacataccggagacggtatttcagacagcacggtacaggcgctgtacgccggattacggactgaaatcccgaccgtcagtgttcccgccgacctgctggcaagggtgacgaatatcgccgggcgggcgctggatacggaggacgctcaggcctggcctcttgtatgtcaggagtaccccggcgttgccgacgctcaggtcgatattgcgcggctcaggcaactggcgctggcggcgtaacgtaccaccccgtaccgggtgacgggcggggtatcaatcacaactgtatgaacacgaagaggaacaacacaatgagaaacacgctcagtacgctgatagtgcgccacggagataatctgttacgccggtccggctggcccgaaaccgtcggcgtgacgcaggtggcccccggtgtggtgcccggctggctggccgtctgcggtgtgctcagtgctgccgaaatcttggcactgacgacgcatctttgtcagccccttaattatggacgggcgcaactgctgacggccagtgcgcagcggctggcggggacgccagtccggttacatctgtacccggtacaggcatatccgcaccctgccacggtacgcgaatgcactgaaattcgccttccgtatgctcaggagtggctgaccacggacgaatatgccgacctgctggcgttcctgaaagcgtccgctgaccgggtatgtgaaattgtccgccaggatacgaagcgcatcgcggcggcgctggcaccgtccggcgagtcccgcctgatggaaaaacgcatcgggaactggcggttactggccgatgaatacgaccatgataactggcttgacgaagaggacgaggacggactggataaggtgctggacgcggtactggtacgtaacgcccgtttctgcccggtgctgctgacgctggttaatgagccggaggaagaaatcgaagccgccggcgtgataaccgactgtttgcgcttcccgggggaaccgaaccgccgctggcttgaccgccgcgtgctccgggatgtggtgaacgaagcccggagtttcacaggcaacatccgttaaataagctgtgtgcggtgaacgataagctgtaaacggtaacgagaaagaaaagagaaggggaggtctccttctcttttttcagtttttcagccggcgactgcgacgatgccggggacgacaggcaaaacaggcaaaaggatgtcgccttttcggctccgcattcacccggctcaggcctgccggccgtcgccttgtggttttccactctgacagtcctgtgtcgtgtgcgggctgtgccgtgcatccatcgtagtcgggctgtcgtggatacaagggtaaagtgcacgcggcggtcacccggtccttccttcacgtcagccgcgatcttccggtcgttcgaccgttcaggtttcacggtctcacccttcagctcccgtcttccgtgcgcgtcaggctgcggcttcccttgcgcccttgcatccacgattgatcgcccgactggtatggatgcacggcaccgcccggtgtcgcggaatatgtgattacggaggttttatgcagtattcaaatcagcaacgtgcgcgtgttattaacgttgaagaatccgaccgcctgtctttcctgccgtacatgttcggcaacgattttatgctggctgaattacagttatatgccctggcgaaaaaatggatgcctgaatacaacggtggtttctggcattttatccgtctgccggaaggcggcggatacatgatgcccgactgcgatcgggtacacatgatcaacggtgaaaactggtttgatcgtaccgtcagcgccgacgctgccggaattattctgacttcgctcgccattaaccgccgttgctggacgcatcacgactgcggcaacgctgcgctcactcgcctgtatatgctgcgtgatacccagctctggaatcacattacgtttcaccctgaatgcaacgctatttacgccgcgctcgactgattaaccgacggggcggcgatgccgccccgctgtaactgtcattcattgatttaagaggagtctgttatgtacggaaccgtcagcaccatctgctgcgacttactgaaagtgtatgagaatcacgaaaaaatcgctgtcatcatctggtgtgaaggcgatgtgcgggaaatgggggcggagtttaatccgaccgctgatgacatacaggccgtactgcgcgccattggcgagtcggacagtgatgcgctctggcgtgatggtattggccagaattttgttgagggtgtattacgcgagttagtcgcactgcgcccaccgcgccagattgctgtacctgaagatgtgctgcgcacgcttttacccctgatggaagccggaatgaaccttcctcgttaccagacgcaggacagggctgctgaagaagaaaccgcgctggatacgttgcgatacctgctttccacaaatatcccggcgcataacctgaccgaaggaaactactgacagatattagtgcgccgtgtacaccggtggtcacttcctcttacagggcggaaaaagcagtcaggcatgatggcaggcggggagggcgcctgtcagcccgcgcgaaaaaacctgcaggctggcgcctgcggggggaaggacaggggccgcgcttcgcgccgctccctgcccttttccccctctgcctctgatggcgtacacttacagccggtttccatttctgtcggaggatgtgatgtccggactgaatctggcggcaacaactaaagaagagcaggataaagtggccattgacctggttgcttcaggcgtggtctataaagaaaggctggcgatgccggtggtcgctgagcttgtcgtcagagaacagcctgagcatttgagagagtatttccgggcgcggctggagtatttgcgcaactcccggacaagaatgccccggaatatgccagaaaagaggatgaggttaaaaaatagcgccattcctgatgcattctgcctgtcgctggccggattttacgcatgccgggtgatgtttttttctggccggggtgtgtgattttcttcctgccggtgataatacgctgcctgttcctgttcctgttcctgttcctgttcctgttcctgttcctgttcctgttcctgttcattctgctgctgatattccctgacagatttcgctgacgccgggcgacttccctgacgggaaccgggactgtcatgctgcgcaccgagccagctgcgctgtctctgcccggccccttcggggcagcgggtttccatcccactgtcgcaacgtcaacggcaggcttgctgcgaccgttccggtcacgccgcccctggcgcgccgtttcctgcgcttttcgcaccccggcggtaaggctgccgggctgtaaggcgcaacgccgtttcgcgtgccgcgtcccgacgttgcggcgggttcctgctcatctccgcttctggtgccgttacccgtttaagtccctgtcgccgggggctgatacagccacaacccgccgcactggctgtccaaggtgaaatgaacagcccacaaaactttttgccgtaaaaggccggcaaaaacttttgcgttctgccccggacaggtgcgtcgggccgtggcagtgatgccccttgcggcgaaggttctcaaacgggtgatggcagtaccagagggaacagaacagcaggtccccgcaaaacgtcaaaaccgcggctcccgaaactcaacgggtgatggtttttaaagtcaaaacaacgcattaaggagatttatcatggcagcacgtggcgtaaacaaagttattctggtcggtcatatcgggcaggacccggaagtacgttacatgcccaacgggggcgcggtggcaaatcttaccctcgccacgtcagaaacatggcgtgtcaggcaggacggggagatgcgcgaacacaccgaatggcaccgtgttgtcgtgtttggcaagctcgctgaaattgccagtgaatatctgcgtaaaggtgctcaggtctacatcgagggccagttacgcacccgcaaatggaccgatcagtccggtcaggacaaatacaccaccgaagtgatcgttaacgtgggcggcaccatgcagatgctcggtcgccacaacagccagccacagcaggagcctcagaccccacctacggcggcaaagggagaaggcaaagcggtaaaaggggcgggaaatgcagcaaaagggaaaaacgcagcagcaccgcagcagccgccagcgcaacccgatccggcgtatgacttcgacgatgatattcccttttgactcggtaaattttcactgatgccccgtctgacggggcttatccaggagaacacgatgacagacaacatcatgagcccactgaaatccctgcctgatggcacgttcacccacgaacaggccgaagcggtggcagcacagtatcagaatgtcgccattgaagacgatcaggggacgcaccttcgcttggttgtgcgtaaggacggcgaaatggtctggcggggctggaattttgaaccgggcggcgagtactggctcaaccgctgtatcgaaagccacggtatccgtaaaacgcagtaagccgtaagaggtgccggacgggaacacgtccggcagacaattattaatatcatgaaggagtatcaataatgtcagttaccaattctaatgcaaaatccgcagtaaaaaccagccgtaaggcgaaaaacgccgccagtgccagtaacaccgtattgtcggcggtgctggcgcagaccgaagaacaacacgtaccgctgtccgcactggtcaaatccccgcagaacgtgcgtatcgtgccgtattccacagagagcgtccgcgaactggcggactctattaaagggattggactgctccagaatctggttgttcacgccctccctgacggcctgtacggtgttgccgctggcggtcgccgtctggcggcgatgaatctgttggccactgagaacacgatccacccggactggcctgtccgcgtgaaggttgtgccggataatctggcgaccgccgcttcactgaccgagaacgggcagcatctggaaatgcaccctgccgaacaaattgcgggattccgcgcgatggcagcggaaggcaaaactcctgcacagactggcgatctgctgggctattcgccccgtcacgtacagcggatgctgaaactcgcggggctggctccggttatcctggaagcgctggctgcggacaaaatcaccacggagcactgtcaggcgctggcgctggaggacaatcccgaccgtcaggtgcaggtgtacgaggcggcgtgtcgagagggctggaacaataaaccggaagtgcgcgtgatccgtaatttgatcaccgacagtcaggtttccaccctcaacaacagcaaatatacgtttgtcggtgaaaaagctttctccggcgatgaaatccgcgcagacctgttcagcgacgaacagggcggttttgtggacaaactggcgctggatacggccctgctggaaaaacttcagtgggtggcggagtgcctgaaagaggccgagggctgggcatggtgcgcgggacggatggagcctgtcagccgctatggtgaggataccgaagtgtaccgtattcaggatgagcctgacgcggtttacacggagcaggaacagcagcgcctggacgagttgcaggaactgtacgacgaaaaccagaccgccagcgatgaaaccgacacgatggagtcagagatagaggccatcgaatgcgcggcacaactccgggcatggacgctggaaatgcgcgcacagtccggcgtggtggtgtcatggcgtcacggtgaaatctgtgtccagcgcggggtgagcctgcgtgagcagtctgaaacggaagatgaacccgatcaggttccggtatatgagcgccagccggagcctgtggacgaaatcagtgttcccctgctgaccagaatgtgtgcagaacggacattgtcggtccaggcggcactgatgcagcagccggaaaaatccctggcgcttctggcatggacgctgtgtctgaacgtgttcagcagcggcgcgtataaccgacccgctcaaatcagcctgaactgtaagcattactccctgacaaaggatgcgccgcccggcgagagcggtgttgcgtttgtgacgctgtcgcaggagggaaaacgtcttgaaacgttgctaccggagggctggacacaggacttcaccacctttttcaccctcagcgccaaagaccttaccgccctgctcagtttctgcaccgcatgcagtcttgacggtatgcagatgcgcggcgccggaggcaccacccgcagtccgctcgataagctggaaatcgcgctcgctttccatctgcgcgactggtggcaaccgacgaaggccgatttcttcactggccttaaaaaaccgcaaatcatcgccgcgctgaatgaggccggactgacaggcgcggcgcgggatgcggagaagatgaagaagggtgatgcggctgaactggcagaggacaaaatgcgtgacaaccgttgggtgcctgtctggatgcgcgcccctgatgcagaaaacgacgtatctgataccgaaaacggcagtgctgatgcagacagccaccacaccctgcccgatgcagcctgataacggaggccgcccttcgggggcggcagcaaggagaaaatgatgcgtaacattattacccccgctgtattgagtacaatgatcccccaggaattcgaagactggcgcgacggcggcgaagacctgcgccgtgaactgacccacgccgcgatgcgtgacctgacatgtcccgcaggctgggacatgaacggcgaatatcgcagtgagtttggtggttttttcccggtgcagatccgtttcacgccatcccgcggcaatttcagcctggcggtatgcagtcccggggatatcagcccgtcctggatggtggtctttattccggtcagcggtcgcccgttctctgttatccgcacgctgccagcctggtcgccggaggttatcacgcatacactcagcctggtggctcaccttgatgccgatggttacagtcaggccagcatcatcagcgttctggcgatggagggcgcagcatgatccactcttcacacgccctggttaccctgaagccagcccgtcaggcggcattacaggccattctgacggtggaagaatcccgccgccgtggagcacgtctgcccgccctgccacatgcgcgtacttttttgcgcgtgctgagcggcagcagccggattaacacgacagtggcacagcgtattcccggtctgaactgggagccgaagaaccggctgaccagcctgaaacaggtggaagaggcgctggatcgcctcatctccagtcacggggagtattgcccgctaccactctccgtggatgtgcaggccgaactgttcccggaggtgatacacgcgcgcacagatcgccggatgcagcgtgagaaaatcgcctttaaccgcaaaatgcgccgggaggaaaaagcgctggaacatgcctggctgctgcgccagaacctgctggggcaggccatgacggagcttaactttcagtcgccggaaaccgtcaatgcctggtatacgcgctgggctgacgagtttgacgcgcgggagctggcgcaggggttctggcagtggcggacgcggtttacctcgctgacgtcgctggactggctgcgcgacagtgatgagccgctgtacaacgtgatgtatgaaatctggttcatcgtccgggaaaacccggtatatgtgcgcgaggccgaacgttggcaggtacccaacaagctgacgaaccggaggcccgggcgacttccctgataaagcccgtctggaaacgcagaccgcccggctgatggatcagctggaggtacaaatccggctcatcccggtggcaacgccgccattgcagcaaaaagtggatgaaatagcacatatgcttcacctgatggcgcagtttgccggaactgaactcaggaagtgacccggatggcggggaatatccccgccccgttatcgaaaggagatatcatgcgtaactttgaatctactgaaagatggtggaaaaaatgaaaagccagctggtagccgctgctgatcgtgcggccatgagtgtcgcgtatggtcaggaagccgcagatcattacggtattcagtatggttttatccggtctgtacgtgactggatcaccggcttcaccgaggggattaaaggggagcgttgttgaataacacccgcttttgttacttgagtgttaacggaaatggcggtgtctccggtcactgctttttcttcagaattttttcattaattatataaggaatacgttatgagactcgcttcccgttttggtagacagaattccattcgtcgtgagagtcctttggctgacgctgaattaatgcagactgtgccttcagttttttccggagacaaacatgaatcccggagcgaacgttatacttatattccaaccattaatatcatcaacaggttacgtgaggaaggttttcagtcgttctttgcctgccagagtcgtgtacgtgatttaagtcgccgggaatacagtaaacatatgctgcgttttcgtcgtgaatgacagattaatgggaaagaggttccggaaattattttgctcaattctcatgacggttcgtcaagttatcagatggttcccgggctgttcagatttatctgtacaaatggactggtatgcggatcattttggtgaaatacgtgtgccacacaagggagatattgttgggcaggtgattgagggggattatgaggttatggggatcttcgataaagccaccgaaaatatggagtcaatgaagtcagtgatacttaatcaggatgagcaatatctgtttggtaaagcggcactgactgtcagatatgaggacgaaaataaaatccctgtttctcctgaataaataattactccacgtcgtcgggaagataaacaaaatgacctgtggacaacatatcagcgtgtacagaagaatatgatgaagagtgggttacccggcaggaatgccccggaaaaaacacccggatcagggcagttaccggtattaatggtgatatccggttaaacaaggcgctgtggatgattgctgaacagtttcgtgaatgtaagtcataataacataagtaaagccccgaaaatttttcggggctttacttatgttattcttcccggacattgtcagattgtctgtaacatcccattttaatcaacagacttcatcgttttctgtcatttatgtgccagcgataaaaacggatctgacagggtggaagaagatatgataacgggttcccgtttcgcgggattccgggcagtcagtattacatttctgtgtttattccattctgctatgcggcataaaaaatatatgggtttcggttgataatattatcccttcttctgcttgccggatacaaaaaggggatcatcgggcgggagtctgcctggttttactttgttttatcgcgatccagattcggtgtacatcagtcgcatagtccagacgacgtgcatcctgaaggggagtctttttaaatccggcgttgtacgctccgactgctgtccaggataccccccactttctgaatgcgattgccagataataagctccggtgtaaatattcaggcagggatcggagacaagttgttccggttttattccataacgagccagttcgttaaagtgctgagagtcaacctgcattaaccccgagccatatcccgtaaccggattaataccgacggcattagcccggttacgggattccttccatgaaatcgcccgcagtaaatccggatctattttatagtctctcccggccagatcaaaacagtcagcggcatggactaccgtgctcattaataccaggaggacagacaggagccatttatacattaatttgcctcttgcgtagtcatccggtaataacttaacccactccaactccatactcaacaaatttgccgtcctcaccaccaaaagcaccacaccccacgcaaaattaaaatttttctgatttgtttttagtaacagtgagttatgttcataataatgtaatttaatttattttaatgtattaaatagcggtgcaggcacgtcgccggcaccgctatgacgacgctatacaggggtagtactgactatttttataaaaaacattgcattatatcaggggcgctgctagcgtcgctgtgcctgtttttaagtaacacccctgggggcgctgccaggggtgttaccccttacagagtgctcctgaatccggagtttataatgttcttattcgttgcggaaaaaaggtgatagtgaatggctaaagtcaatgtatatataagtaatgaggtacacaataaaataactgctattgtggaaaaacgacgccaggaaggggcgagagataaagatatcagtttttctggtacatcttcgatgttgctggaattagggcttcgtgtctatgaggcacaaatggagcgtaaggagtcgccatttaatcagacagaattcaataaagtattacttgaaaatgtacttaaaacacagtcatccgtagccaaaattttaggtataggatctctcagccctcatgtcgccggaaatccaaaatttgaatatgcaaatatggttgaagatatcaaagaaaaagtatcttcagagatggaaagatttttccatgaaaatgaagaataatagcgggattaaatcctgatttagtttaaataaaagtatgttgatctataaaaatatagtgacaaattaaggctgaaaacaatatagtgtctttgtagttaacgctacgttaaaaaaacaagttaaatcgccgatacagggagctgtcactccctgcatcgactgtccatagaatcctttgaggaggttcctatgtgtccgacggatcgtagagaaagaacactcgccagtcaatctgtaaataaatacattctgagtattcaggatatctataaaaactcaccagtccctgtttgcgtccgtaatcaaagtcggaaaatcatttacgcaaatggagcctttattgaactcttctctaaagaggatcagcctctttcgggagatagttataatcgttatggggttgaagtttttctgtcatccctggaacttgaatgtcagtcgcttggacatggagctgctttttgccggcgttttaattttcatggggaaatttatcagataagaatggagaatatttcattcgataataatgagataattgtgttgtggcagataaatttatttccagatcatccatttttttctcctgacacaaaaactaaaaatttgtctctctcaggaactgaatcattctggaacgaactgtcccccggaactttgcttgttttttctttttatacattaggagttagtcacgcaaatatagctaaagaattaggtattactatcagagcatcagaagacagaatcaaacctgttaagcgtaaaattaaaaggaattatgaatctttcgattcattcagaatatcatgtatttctaaaggtaaaataatatcattgatagacattattcgtgaattttattgtgttaagtgaatgttaattaaggcgcgccatttttggcgtgtttttttttgccgttttccgtgtaatcataagtttattagtcgtgtaagcagaggtgaatttgtgaggaggagaaacgcaagagaggggataagtcgaactgtctcagtgtatctcgatgaagatacgaataaccgtcttatcagggctaaagatcggagtggaagaagtaaaacaatagaagttcagattcgtctgagggatcatctgaaacgatatccggatttctataatgaagaaattttcagggaggtaattgaagaaacagagtccacatttaaagagatttaactttcatattcatagttgatattactcaaaagaggaaccatatgagcgctattttaagtgttcagggtgcttctgcgcccgttaaaaagaaatcgtttctgtctacgttcacacgtctgaacctgctgaaacttgcccgcgcagtgatcccggcggcagtactgatattctttttcccgcaactggcaatggctgccggcggttcgcaggacctgatggccagcggtaacggtacggtcaaggcgacatttggtaaggattccagcgccgtcaagtgggttattctcgcggaagtgctggtcggtgccgtgatgtacatgatgaccaagaacgtcaaattcctggcgggttttgccatcatctcggtctttattgccgttggtatggctgtcgtcggcctctgacaggaaataagaccatgtcgggagacgagaataaactcaggaaatatcgtttcccggaaacactgaccaaccagagccgctggtttggcctgccggtggatgaattaattcctgctgctgtctgtattggctggggattaatgacatcaaaacaacttttcggcatcagcgctgcggttctggtttatttcgggataagaaaactgaaaaaagggcggggaagctcctggctgcgtgacctgatttactggtatatgccgacagccctgcttcgcggtatttttcataacgttcccgattcgtgtttccggcagtggattaagtaatcattattccgggatgagtatatggaacacggcgcccgtttaagtaccagccgcgtactggcaataagttttatttttatggccctgctgattgtgctcagtctggccgtgaatgtcattcagggtattaataactaccggctgcagaatgagcaacgcacggcggtcactcctatgggatttaacgcgtcctttgcggtgtcacagaacagtgccgatgcctcttatttacagcagatggcgctgtcgtttattgccctgcgtctgaatgtgtcgtcagaaaccgtcgacgcgtcacaccaggcacttctgcaatatattcgttcgggcgcacagaaccaaatgaaagtcattctggcagaagaagcgagacgaattaaggccgacaacgttaactccgcttttttccagaccagtgtcagggtctggccacagtatggccgcgtggaaattcgcggtgtgctgaaaacctggattggagattcaaaaccgtttaccgacatcaaacattacattcttattctgaaacgggaaaacggcgtgacctggctggataatttcggggaaactgacgatgagaaaaaataagccgtataagccatttttactggcggccggatggttattttccggtctggtgatggcgtcgggttccggtacgctggccccggtggtggtgtccctggctaacggcggtcaggcgaacattgctgtcagcaacaccgacccgaacctgtttacggtaccgggtgaccgtatcactgcggtcagcggtctggacggcatgctgacaaacagtgagcagacaggcacgggcggcgtggtggtggccacggtcagtaaaaagccgttcaccttcattctggagacggagcgcgggctgaacttttccgtccgggccgtcccccgggccggtgccggacgcaccgtacaactggtcagcgacctgcgcggaaccggggaggaggctggcgcatgggaaacggccaccccttatgaatccctgctggttgccgtcagccaggcagttcgtggaggcacgctgcctgccggctggtatcagatccccgtcacgaaagaagcgctgcaggccccggccggtctgtctgcacgggctgacgctgtgtggaccggcaatcacctgaaactggtacggtttgctgtggaaaataaaatgccgtcagccctgaacatcagggaaagtgatttctggcagcccggaacccgcgccgtgatgttcagccagcccgtcagccagatactggccggcgcacgaatggacgtgtacgtcatccgtgacggggagggcaactgatggcgagcatcaatacggttgtaaagcgtaaacagtacatctggctggggattgttgcggtgggggctgccgctgccattggcggaggcctttacctgtctgacgtcgacatgagtggcaacgggacggccgcagagcaggagccggtaccggatatgaccggggtggtggacacgacctttgatgacaaagttcgtcagcatgccaccacggaaatgcaggtgacggcggcgcagatgcagaaacagtacgacgaaatccgccatgagctggatgttctgaataagcagcgcggtgacgaccagcgtcgtattgagaagctggggcaggacaacgccgccctggccgaacaggtgaaggccctgggagcgaacccggtgacgaccacaggagagcccgtgccgcatacacctgtctcaccgcccggtccggaaggagaacctcagccgggtaatacgccgatgaccttcccgccacagggagccgttcctccgccaaccgctttttatccggggaatggcgtcacgcctccgccacaggtgacataccagtccgtgccggtgccgaaccgtatacagcgtaaaacgttcagctatgacgctgccgcgaagaaaggtccctccctgccgtatatcccgtccgggagttttgcaaaaaccatgctgatcgaaggagcggatgccaatgcctccgtcaccggtaatgaatcgacggtccctatgcagttgcgcattaccggcccggtggagatgccgaacagtaaaacatatgacctgacagggtgctttgtgggtctggaagcctggggggatgtgtccagtgaacgcgcgatagtacgtacccgtaatatcagctgcctgaaggacggcaaaaccatcgacatgtcggttaagggacatgtcagcttccgtggaaagaacggcatcaagggtgaagtggtgatgcgtaatggcaaaatcctcggctgggcgtggggcgccggttttgtggacggtatcggccaggggatggagcgggcatcccagcaggcggtggggctgggggccactgcgacttacggcgcgggcgatgtgttcagaatggggattggtggtggtgcatcgaaagcggcacagacactcagtgattattacatcaaacgtgccgagcagtatcacccggtgatcccgattggtgccggtaatgaagtgaccgtggtgtttcaggacggttttcagctgaaaaccgtggaagaaatggcacaggagcaggcccgtcaccggaaggaggatgaaaatgcggaaagcccggtgcctatacctccgtcagtcgacagccatatgaacggctttaacaccgaccagatgctgaagcagctgggtgacctgaatccacagcagtttatgtccggcagccagggaggacatgtaaatgggaaataaccggctgaacaacctgaagggacgtgccgttttatatcgtattgccggtcttctgcgctggctgatatggggcgtgaaatatgccgttatctggccgctggccacaacagccattgttgtcattctgctcttccggacgggggataccacgccgggacaacagatggcgcaggaaatcggacgggtgagggcaatggccccgtccgggatgtttccggtccgggactgccctgacccggctttcacggtgtcgtcacctgtaccgctgaatctgacggaaaactgtccgctaaaaataaccggcgcggaagaatacgcggcagatatcgaccagtccctgtcgcaaacgggatggctgttatgggggatgctggcgctgttgtataccgcggtggcagtaatgatcggagaccggccgtaccgtcacaatccactgacatatgcgtatgacacagcgacaaacaacctgaagtatattgataaagaaaacgaaatccggactttaaaagtaaatacaaacgggcaggtttcttattctggtaataaagaggctaaaaaagagggtgataaaaatgaacatacgtaatgttatttcagttcctgatgaatccgtgcaggatgattttgtgaaatatgttatcagtaactgcactacaaaaataatactctccggtcgccgggaatataatttctcacgacaggaatataatttttcagttaccggaatgcctggcgcagggaaaacatgtgttctgtctgaattaatcaaaaagctgctgcgtgagaataagaaaggggcgaaatcatgaaccggatttcatgcctgatccctttctgtggcgcgcttctgctgtccggatgcgccggaacgaactccgactttgaatgtaccgccaccacgtcagacacctgtatgacgatggagcaggccaatgaaaaagcgaaaagacaggagcaacctgagacggtaaagccgggtgcggtatcactgccgcgcctggctgagggtaactttcgcacgacgccggtacaggtagtcagtaccgtcactctacccgtcgcaaagaccgtggccgccccgcgttccgggcagaaaccgccggcaccacacccgctgtttacggctgcccgggaggtgaaaccggtggcggctgtcagtacggtctctcctgtggtgccgccccgtccactgagaaccagggagcagacggcggcgttatggatagcgccctatattgacagccaggatatttaccatcagccgtccggcgtattttttgtcattaaaccgtccgtgtggggaaagccacggattaattaactgacgcgtcagtcagatatcagccggcaatgccggccggctttctgtattcaaaacctgcctgtaaaacgagtgccctgtgcgtgaaaagggacgggcggtagcgtgtcagaacgtgtcaggagacatattccatgagcgatgaagccgatgaggcatattcagtgacagaacaactgaccgtgacgggaataaaccggatacggcagaaagtaaaccgtaaaggtattccggtttaccggtgtgaagcatgcggtaatcccattccggaggcgcggcgaaaaatatttcctggcgtgacgttgtgtgtcgaatgccagtcttttctggaaaaacagggcaggcattatgcataaatcagacgctgaaaaaatggaatccattattgataaacatgaccggatataccgacgacaggtgcgggtatttaaaaacctgggcttcctctcaataattaccgccgtactgagtgtgattactgcgttattcagtacctccctgctcctgaaatacacgctgtgtgtcgtgatatgcgtttgtctgatttatctggtttttatgttcttctgcctggacaggtatatcgcgctcagtcgtcagacactgctgtggctgttgcgccgggtggaagataccgcagacgttcgccgggagctgctccgccgcctgctgtccgggaaaacgctgaccggacgggatgaagacgacatcctgcgtctctggtgggagagcagtaatgaagtggaggagcttgcaacccgtcagcgtgaacaggatgccatccggaagtttgtcggcggggataaatcagaatgaaggtttatctgcagcgttacggcgtggccggttttctcctggtgtactggagtctttcctttgtgaatgaatatttcctgcataagcatccgctttctgctgaatcctggaagtgaatgagattacaggcgctgctggtaacaggctctgttgtggtgaccgtgctgcggctttttctcctgaactccgtggtgcgccgggaggcaacggccatcatgaccggggtcgctgcaggtcttcatgtttttgctctgctggctccttccgtctggttgttttatcagtggcagtggaatggactgtttcttctgcagtggcagggagcagtcttcctgttctgtctgttcgcgcttcccgtttcaacattctgtttttcttaaggttaaggtgttcgtgtgaagaacctgcttgatactgtcactcaggcggccaactcgctgctgaccgcgctgaagctgccggatgaatcggcacaggccaatcagatcctcggcgagatgagcttcccgcagttcagccgtctgctgccgtaccgggactataaccaggagtccggcctgttcatgaatgacgccacgatgggctttatgctggaagccacgcctgtcaacggcgctaacgagaccattgcgctctcccttgaccatctgctgcgtaccaaactgccgcgcgggatacccctgtgtgtccacctgatgtccagccagctggtcggggagcgtattgagtacgggctgcggaagttctcctggtccggtgagcaggcggagcggttcaacgccatcacccgcgcctactacatgaaagccgcagagactcactttccgttaccggaaggaatgaacctgcccctgaccctgcgccattaccgggtgttcatctcatactgcgcgccctccagaaaaaaaagccgggccgatatcctggagatggaaaacctggtgaagattatccgggcttccctgcagggggcatacatcagcacacagaccgttgatgcgaaggcatttattaatattgtcggggagatgattaatcacaatccggaatccatccatccgacccggcgccggctggacccgtattccgacctgaattaccagtgcgtggacgactcctttgacctgaaggtcaggcaggattacctgacgctgggactgcgcgataacgggaaaaacagcaccgcgcgcatcatgagttttcatctggcccgtaacccggaaatcgccttcctgtggaactcggcggataattacagcaatctgctgaacccggagctgtccatctcctgtccgttcattctgacgctgaccctggtggtggaagaccaggtgaagacccacagcgaagcgaacctgaagtacatggatctggagaagaagtcgaagacctcctacgccaaatggttcccgtccgtggagaaggaagcgaaggagtggggagacctgcgccagcgcctggcgtcgaaccagtcctcggtggtgtcctactttttcaatatcacggcgttctgccgcgacaacaaggaaacggcgctggaaacggagcaggatatcctgaacagtttccgtaaaaacggttttgagctgatttcgccgcgctttaaccacatgcgtaatttcctggcctgcctgccctttatggccgggaagggactgtttaagcagctgaaggaagccggtgtggtgcagcgggcggagagcttcaatgtgaccaacctgatgcccctggtggcggataacccgctgacgcccgccgggctgctggctccgacctaccgtaaccagctggcctttattgatattttcttccggggaatgaacaacaccaactacaacatggcggtctgcggaacttccggggcgggcaagaccgggctgatacagccgcttatccgcagcgtgctggattccggcggctttgcagtggtgtttgacatgggggacgggtacaagtccctgtgcgaaaatatgggcggggtgtacctggacggggagaccctgcgttttaaccccttcgccaatatcaccaatattgaccagtcggccgaacgtatccgcgaccagttgtcggtgatggccagccccaacggcaaccttgacgaagtccatgagggcctgttgctgcaggcggtcagggcagcctggctgacaaaaaagaaccgggcgcgtattgatgacgtggtggattttctggaaaacgcccgcacgagcgaacagtatgcggagtcacccggtatccgcagccgcctggatgaaatgattgtcctgctgaaccagtacacggcagcaggcacttacggcagatacttcaactccgatgaaccctccctgcgcgatgatgccaggatggtggtgctggagctgggtggcctggaagaccgcccgtccctgctggttgcggtgatgttttccctgattatctacatcgaaaaccggatgtaccgcacgccgcgtaacctcaaaaagctgaacgtgatcgacgaaggctggcgtctgctggacttcaaaaaccgcaaggtcggggacttcatcgaaaaaggctaccgtactgcccgccgtcacaccggcgcgtatatcaccatcacgcagaatatcgtcgactttgactccgacaaggcgtccagcgccgcccgcgcggcatggggtaactcttcctacaaaattatcctcaaacagagcgccaaagaattcgcgaaatacaaccagctgtatccggatcagttcccgcagctacaccgggagatgattgagaaatttggcgccgcgaaagaccagtggttcagctcgttcctgctgcaggtggaaaaccattcctcctggcaccgtctgtttgtcgacccgctcagccgcgccatgtacagctcggacggtcctgattttgagtttgtacagcagaagcggaaagaggggctgagtattcacgaggcggtctggcagctggcgtggaaaaagtcaggaccggagatggcctcgctggaggcctggctgcaggagcatgagacattcaggggaacttatgagtacaaagcagaaacagactgacggcacgggagcgcgtaagcgtgacgggctgtggatgataccgggatgcctggggatggtggtacttaacgccgccatcagttacgggatagtccggctgaacacgccggtgacggtggcattcaacatgaaacagaccgtggatgcgttttttgacagcgccggccagaaaaaactgacggaagcgcagtcgaaagcgttgtccgggcgctttaatgcggccctggaggccagcctgcaggcgtggcagcgggagcaccatgccgtcattctggtttcaccggcggtggtacagggcgcgccggatatcacccgggagatccagcaggatattgcccggcgtatgagggcagagccgtgaaatggcgggggctgacagccctgctgatatgggggcagagcgtggcggccgcagacctgggcacctggggcgatctgtggccggtgcaggagccggacatgctggcggtgattatgcaccggctggaagccctgcagcagtccggtgagatgggccgccggatggaggcctttaaggagcgggtgatccacaacagcctgcgaccgcctgcggtgccgggtatcgggcgcgcggagaaataccgcagccggctgtttgatccgtcggtcagactggcggccgatatccgggataacgaaggacgggtgtttgcccgtcagggggaggtgatgaatccgctgcagtatgtgccctttaaccagacgctgtatttcattaacggcgatgatccggaacaggtgtcgtggatgaaacgccagacgccgccgacgctggagagcaaaattattctggtgcagggcagtatccctgagatggagaaggcgctggacagccggatttactttgaccagaacggggtgctgtgtcagcgcctcgggatcgaccaggtgccggccagggtgacggccgcaaaagacgggcgtttcctgaaagtggaatttattccggcggaggacggcagaaaatgaaacggtatctgtggctgtgtgtactgattctgctggccggtcatgtccccacggtatcggctgatgcggcctgtgaaagtcgttttgtaaacccgatcacggatatctgctggagctgcatctttccgctgtcgctgggcagtacaaaagtgagtcagggaaagctgccggatacggccaatccctcaatgccgctccagttctgtccggcgccgccgcccatttttaagcgtcccggactggcgattggctactgggagccaatggcgctgacggacgtcacccgctctccgggctgcatggtgaatctggggttcagcctgccggccttcgggaaaacggcacagggtacggcgaagaaggaggataaacaggtgaacggggcgttctaccacgttcactggtacaaatacccgctcacgtactggctgaatatcatcacgtcgatggggtgtctggagggcggtgacctggacattgcgtacctctccgaaatcgaccccacgtggacggacagcagcctgaccagcattctcaatccggaagcggtaatttttgccaatcccatagcccagggggcctgcgcggcagatgccattgccagcaccttcaataaaccgctggatgtcctgttctggtgtgcaggctctcagggctccatgtatccgtttaacggctgggtgagtaacgaatccagtccgctgcagtcctccctgctggtcagtgagcggatggccttcaaactgcaccggcaggggcaaattatggagaccatcgggcagaataccgccgtctgctttgaatatccgtcgcccattctccctaaagagcgctggcgttatcagatggtgaacatgtatccggacagcgggcagtgccacccgttcgggcgcagtgtgatgcgctgggaaaccgggaaaaatccacccaacacgaagaagaactttggctatctgatgtggcgtaagcgcaactgtgtatttctgtaaaccgataccgaagagagggtgtttatgcgaattatttataagagacagcattatctgtccgttatcaggtggggggcggttgctgtcgtgcaggtcctgaatgagagtgtaaaactgtttccgtttgcgctggtgatgtttgcgctgatggctttttattttcttccggaacgcatcatctctgatgttgttaattcgtggatggaaacagacacgaccggaaaaatatcgctcatcagactttacctggaagtgacatttatgctgtccctcgagtcttcttctcttttatttatgtaccggggaaagcgatgcacaggaaaataaaatacctggccggactgattatggtcataagcgggacggtatcagccggcggagtcgctaatacccctgaaaaccgccagttcctgaagcagcaggaggaactgagccggcagttgcgcgaccggcctgatgctgaactgaaagcgtgggcagaccggcagattcaagcgaatcccctggtgcagtcagaccggcatttcctggatgaccttgcccgaaagcagcagacttctcaggcggataaaccggagcagggcgcggtgtactttatctcgttttccattccggaagaggggctgaagcgcatgctgggcgaaacccgtcgctacggtattccggccacgctgcggggaatgcgggataacgacctgaaagccacggcagatgccgttctgtccctggtaaaggatggggcaacagatggtgtgcagattgacccgacgctgttcacgaaatatgacatccgcagcgtaccgactctggtggtgtactgccgacagggatatgacgttatccggggcaatctgcgggtgaagcaggcgctggagaaagtggtcaccgccggggactgcaggcaggtggctgccggattacttgatggtgccggagataaaccgcaatgacattccctgcggaataaacagcaggaaggagatgttatggcgctgaccagaaaacagcgggaaagactgcgtatgaaattcggcggccgctgtgcttactgcggctgtgaactgccggagaaaggatggcatgccgaccacgttcaggcagtgctccgcaaatcagagcggtgcatgaaggcggcagagaaaggcattttcagactgaaatccaccggtgacgttttcaggccggaggccgactgtccggaaaacatcttcccgtcctgtgcgccgtgcaatttgctgaaaacgacatattcgctggagatgttcagaaaacaggtctccctgcaggttgagcgggggcgccggagcagcgttaacttccggacagcagagcgttttgggctgattagtgtggtgaataaaccggttgttttctggtttgagcaatacgagggggagaataaatgaaacgtatgttacctctgtttctgcttctggcagccggccaggcacaggctgacagtaacagtgattatcgtgcgggttcagattttgcccatcagatcaaaggccagggcaccggcagtatccggaattttaatccgcaggagagtatacccggctataacgcgaatccggatgaaacgaaatattacggtggcgtgaccgccggtggtgacagtgggctgaagaatgacggcacgacgcagtgggccacaggcgaaaccggtaaaaccattacagaatcgttcatgaacaagcccaaagatattctgtcaccggatgcgccgtttattgaaaaaggaagggatgtggtgaaccgtgccgacagtattgtgggaaataccgggcagcagtgcagcgcgcaggagattaaccgcagcgaattcacgaattatacctgtgaacgcgacaccactgtggaggaatactgtacccggacggccaccatcaccggcgactggagagagacaacagaggtcagaacctacaccctcaccgcctttagtttcagccgttccggtaagcagatcgttttcagcgtaaccgtgccggaagcgggtacgataagcagcgccagcctgaatgtgatcacacagaattatctgtggaattcccgtgccggctttatgaataccatcttcaacatgacgtggggcagtaccattacactgggtggcgcgacgggaatgatgctgagtaagggccagattctgagcgggacaagctgcagcgggaacggtagctgtaccgggacgctggatgaccgcatttttaacgaactgaccagcgggagaacgacgttcacgctgacactggtgatgcaggtaaaggaccgggagtggataccccgggtggagtgggtggaaagctgcccgtttaataaagcggatggcgtgctgaaaggcacagaatgctcagagccaggtggtacgaaaaccggggtgatggaaggaaaaccctggagcctgacggaggcctgctgggcataccgcgataaatatgtcacccagtctgcggacaatggcacctgccaggcgtatgtggacaatccggcctgtactcttgccacccggcagtgcgcgttttattccggtgagggcacctgcctgcatgagtacgccacgtactcctgtgagtcgaaaacgtcaggaaaggtcatgatttgtggcggggatgtgttctgcctcgatggggaatgcgataaggcgcagagcggaaagagcaatgattttggcgaggcggtatcgcaactggcggcgctggcggcggcaggtaaagatgtcgcggccctgaacggtattgacgtccgtgcattcaccggacaggcgaaattctgtaagaaggccgcagccgggtacagcaactgctgtaaggacagtggctgggggcaggatatcggtctggctaaatgcagtagtgacgaaaaagctctggccaaagcaaaaacgaacaaactgacggtcagtgtcggggaattctgttcgaaaaaggtactgggtgtctgtctggagaagaaacgcagctactgccagtttgattcgaagctggcgcagatagtccagcagcaggggcgcaacggccaactgcatatcagcttcggcagttcaaaacatcctgactgccggggtatcaccgtggacgaactgcagcagattaaattcgaccagctggacctcacgaacttctacgaagacctgatgaataaccagaaaatcccggacagtggcgcgctgacggagaaggtgaaagaacaaattgcagaccaactcaggcaggccgggaaataaggacagtcagatgaagataatgtcttttctggttcgggtggtggtgacgcttattgtgatatccccagcggtgtactggtcatgggatgcggtaagcacaaccacagcggacgatatcatgctggcggtgctcattattgccgcttacggtctgatgttcacgctgctgttctgtttcgtgaatgtactgacgaaactactgcagcatgataatgaatccagttgaaggggggtatgatgcgaaaaatacagaccgtatgggtggcagcgttactctgtggctccctgacggcatacggaaaagatgccggatggcagtggtataacgacccggtaaaattacctgacccaaaaacgacggataaatccgctcaggttcgtcaggagcctgacattatgcagaaattatctgcgctgcagaccgcaacaaagcgggcgctttatgaagccattctgtatcccggtgtggataattttgtgaaatatttccggctgcagaattactggacgcagcaggcggggcttttcagcatgagcgccaaaaaagccatgctggcgcatcctgaactggactataacctgcagtacagccactacaacggcacggtacgtaaccagctggccgcagaccaggctcagcaacggcaggccatatcaaagctggctgaacactacggtatcatgttcttttaccgcgggcaggaccccattgacggccagctggcgcaggtgattaatggctttcgcgccacttacggtctgagcgttatcccggtgaccgtggacggggtgattaacccgatgctgccggatacgcgtcctgaccaggggcaggcgcagcgtcttggtgtgaaatatttcccggccatgatgctggtagacccgaaacagggcagtgtccgtccgttgtcatacgggtttattacgcaggacgacctggcaaaacagttcctgaatgtgtcagaagattttaagccgaatttctaaagtaatatcaggggattgtattactgtcactcgttcgcaggtaaataatgcagatgaagcggctgtctttatgccctttatttttaattcagataaatagcccccactgttaaatagtttattcatggcggcgttttttagctgatgaatattctgttctctgataataaatcaggtatcgcatatattaaataacaatggagtgactccactgtgcgtaaatataaattatcgcttcctttaccggatattactggagtatgggttttctccctgggcgtctggtttcacattgtcgggcggctggtttaccgcaaaccctggatggctttttttctggcggaactgattgccatcattctggtgttgtccggcgcttaccgggtgctggatgcctggatagcccgcgtcagccgggaagagcgtgcgttactggaagcccgtcaggctgccattctggctgctgaaaaagaagaaaagggggataaatcacatgtctctcaataaggctttgctgttcctgttgcttctgatggggacgggggttaatgcctccacgcgggaagagattgaacggctgtataacccgcacgggatggccgcaccgtccgggcaaaagcagccagcagatacgcagggcgtgcagaaagtaacgccggcgccccgctggtttcgtctcagcaacggtaaaacggttaacctcgccgactggaaagtggtgttgttcatgcaaagaagctgcccctggtgccaccagtttgacccggtactgaagcaggtggcacagcagtatggattttcggtattcccttataccctggacggacagggggatgccgcgtttccggaggcgctgccggcaccgccggaagtgatgcagaccttcttccccaatattcccgtcgccaccccgacaacatttctggttaacgtgaacacacttgaagcattacctcttttgcagggggccaccgacgccgccggttttatggcccggatggataccgttctgcagatgtacggagaaaaacatgcagggtaaaacgagaattaaaccgcttttcatattatgtacggcgctgatgaccgtcgcacccgccgtctctgccgatgtgaacagcgacatgaaccagttcttcaataagctgggctttgcttccaataccacacagccctccgtctggcagggacaggcggcaggatatgcctccggcggctctttatatgcccggacacaggtaaaaaatgtccagctggtctccatgaccctgccggatatcaatgccggttgcgggggcatcgatgcctatctcggctcattcagtttcattaacggcgagcagctgcagcgttttgtgaagcagattatgagtaacgccgcagggtacttttttgaccttgcgctgcagacgacggtgccggaaatcaaaacggcaaaggattttctgcagaaaatggcctccgacattaacagtatgaacctcagctcctgccaggcggcgcaggggattgtcggggggcttttcccaaaaacacaggtctcccagcagaaggtctgccaggacattgccggtgagagcaatatttttgccgactgggcggcgtcccggcagggatgtactgtgggcgggcaatccgacagcgtcagggataaagccagtgacaaggataaggagcgggtgaccaaaaatatcaacatcatgtggaatgctttgtccaaaaacaggatgtttgacggcaacaaggagctgaaagagttcgtgatgacgctgaccggttcactggtttttggacccaacggcgaaatcatgcccctgcctgccagaaccaccgaccgggctattatccgggcattaatggaaggcggaacggcgaagatataccactgcaatgattcggataaatgcctgaaggtggtggccgacacgccggtgaccatcagtcgcgacaatgcgctcaaatcacagattacgaagctgctgaccagtattcagaacaaggcggtcagcgacactcccctggataataaggaaaaagggtttatctccagcaccaccatcccggttttcaaatacctggttgacccgcagatgctcggcgtgtcaaccagcatgatttatcagctgacggattatatcgggtacgacatcctgctgcagtatatccaggagctgatccagcaggcccgggcgatggtggccacagggaattatgacgaggcggttatcgaacatatcaccgacaacatgaatgacgcgacccggcagatagcgtccttccaggcgcaggtccaggtgcagcaggatgcgctgctggttgtcgaccgtcagatgagctacatgcgccagcagctgtcagcccgcatgctcagccgttaccagaacaactatcattttggcggaggtgcgcagtgaacgaagtctatgtcattgccggcggagaatggctgagtaataacctgaacgccattgcggccttcatgagcacccggacgtgggactccattgagaaaattgcgctgaccctgtccgttctcgcggtgtccgttatgtgggtacagcgacataacgtgatggatctgctgggctgggtggcggtgtttgtgctgatatcacttctggtgaccatacggacatcagtacagataattgataacagcgacctggtgagggtttaccgggtggataatgtgccggtcggactggcactccccctttcgctgacgacccggatcgggcatgcgatggtggccagctatgagatgatttttgcccagccggacagcgtcacctacagcaagacaggtatgctgttcggggcgaatctgattgtgaaaagcaccgatttcctgtcccggaatccggaaatcattaacctgtttcaggactacgtccagaactgtgtgctgggggatatttacctcaatcacaaatattccctggaagaactgatggaatccgatgacccctatacgctgattttttcccgcccaagtccgttgcggggggtttatgacaaaaataatcattttgtcacctgcaaggatgcgtcggtcacgctgaaagacaagctgaatctcgatacaaagacaggaggcaagacctggcattattatgtgcagcagatatttgggggcaggccggaccctgacctgttattcagggaactggtaagtgacagttacagttatttctatggctccagccagtcagccagccagatcatgcgtaagaatgtaacaatgaacgctctgaaagaagggatcaccagtaatgcagcccgtaacggtgataccgccagtctggtgaatctggccaccacatcctcgatggaaaaacaacgtttgtcacatgtctccattggttatgtgacaatgcgaaacctgccgatggtacagactattctgctggggatagccatcgggattttcccgttactggttctggccgctgtctttaataaactgacgctgtcagtgctgaaagggtatgtatttgccctgatgtggctgcagacatggccgttgctgtatgccattctgaacagcgccatggtgttctatgcgaaacagaatggtgccccggtggtgctgtcagaactctctcagatacagctgaaatattccgatctggcatcaaccgcaggttatctctctgccatgattcccccgctgtcgtggatgatggtaaaaggtctgggcgctggattttccagcgtttacagccactttgcgtcttcgtctatcagcccgacggccagtgcggctgccggcgtggtggacggcaattattcctacggcaacatgcagacggagaacgtcaacggcttcagctggagtaccaacagtaccacgtcatttggccagatgacttaccagaccggtagtggggcgaccgccacgcagacccgggacggcaatatggtcatggatgccagcggtgcgcagtccagactgccggtgaatatcaacgcgacccggcagatagcggcggcacagcaggagatggcgcgggaagccagcacgcaggcagaaagcgccctgcatggtttcagcagcagtatcgccagcgcctggaatacgctcagccagttcgggacgaaccggggcagcagcgactcagtgaccagtggtgctgacagcaccatgagcgcgcaggattccataatggccagccggatgcgcagcgcagtggaaagctatgcgaaggcacataatatcagtaatgagcaggccactcaggaacttgcagcgagaagtacgcgaacatctgggggtatttatggtgatgcaagtgcagagtggggcataaggcccaagatattgggggtcggtggtggagctggtgttaaagccggtggtcgtgctggtattgattggagcgatgatgatacgcatcaggccagcagtagttcacgatccagccaggatgttcgtcatggtgttgatgccaaagccacgcaggattttaaggaggccagcgattacttcacgagccgtaaggtcagtgagtccggaagccatacggacaataatgctgattctcgtgtggatcatttgtctgccgccctgaactcagcgaaacagagttatgaccagtacaccacgaacctgacccgcagccatgagtatgctgagatggcgtcccgtacagaaagcatgagtgggcagatgagcgaagatttgtcacagcagtttgtgaattttgtgcaaaagcatgcgccacaggatgcagaaaatattctgacaaataccagctcgccggaggtggcagaacgacgtcgggcaatggcttgggcctttgttcaggagcaggtacagcctggtgtggataatgcctggggcgaagcccgcggtgatattggcagtggtatgagcacagtatccggtggtggtgataaacaggatgtggtagccgatcatcaggcccatcaggcaacggtggaacaacggacgcgggacagtaatatcagtaatgatgtaaaaaaccaggttgataatatggtcacagactatcattccgatataaacgatacttatggaaatatccagggtgaggaaaagactattgaccagcagtattctggcctgcaaaaacagtataaaacagaagcactatctcagaataataaatataatgaagaaaaggctgcacaggaaaggatgcctggcgcggatagtcctgaagaactgatgaagagggcaaaagagtatcaggataagcacaaacagtaaggcgatatccgggaggtgggaatgaaaaatttagctcagattgttctggtgacagtggtacagtttattgcctgttatctagctgagtggggagtcgctgaaacagggattatcctgttatttgtcctgctgtggcaggggctgtttatctggttatttattcaaattcgtaaaaaaaataacatatctgatgagttcaagtttagtaaaggaatttggtatgtaattatgcccgtatgctcattactctcgccattattaagtttaatgatttttatcggtggaacattatatgaattaagacgagtaagtggttgtataagcataaaagagtgggtgaaatgtcagcttgatgaccaatatgatgaagatagggggctggattttgaatctgttgagtatcgtcaaacgacttactacaacccctcaactggatatcctatgcatggaggagttgattcggctggtaatacttttgggtctcgctggcaggataataatgacaggtaataagaaaactatggttggtaaataaaggtaattggatgaaaatgaaaaaaataatgatggttacactggtcagttccactctggccctgtcagggtgtggtgcgatgagcacagcaatcaaaaagcgtaatcttgaagtgaaaacccagatgagtcagaccatctggcttgacccgtccagtgaacggacggtgtatctgcaggtgaaaaatacctccgataaggatatgagtgaccttcagagcctgattgcaaaagatattcaggcaaaagggtatactgtggttacctcaccagacaaagcatactactggattcaggccaacgtgctgaaggccgacaagatggatttgcgtgagtcccagggatggctgaaccgtggttatgaaggtgcgctctccggggcagcgctcggggccggtatcacagcgtataactctaactcagcaggtgccacgctgggagtagggcttgctgccgggcttgtggggatggccgctgatgcgatggtggaagatattaactacaccatgatcaccgacgtacagatctcagaacggacaaaagcgaccgtgacaacggacaatgttgccgccctccgccagggaacctcgggtgccaaaatccagaccagcaccgaaaccggtaatcagcataaataccagacccgtgtggtatcgaatgccaacaaggttaacctgaagtttgaagaggcaaaaccagttctggaagaacaactggccaaatcaattgcaaatattctttaatcatcttcaggaggccggtctgactggcttcctgactgacgcctcgctttgctcgttgtccaggcccggaaagaaataaaataaatttcatttctctccggcgtttccgaaataaatatgaaaacactgagcggttgtgcaaattctttgtgcgtccgtgaagtgttgccgcgaagcgggaataataaggatacggaatgccattatcagaacttctttgtcacatgactaacggcaatccgttttcctgactgtttgctgtactggtagtctgtgctgctgttctttattttctgaaaaaacgaaagtaacggttagttatttattcaaattaattccccgtccggactgataatctttctttggaataacatctatgagctttaatgcgaaggatatgacccagggcggtcagattgcgtccatgcgtattcgcatgttcagtcagatcgccaacattatattttactgcctgtttattttcttctggatactcgtcggcctagtgttatgggtgaaactcagctggcagacgtttgtgaatgggggtatctactggtggtgtaccacgcttgaaggaatgcgggatttaattaaatcccagcctgtctatgagatccggtattacggccagacgttccggatgaacgccgctcaggttctgcaggacaaatacacggtctggtgtggggagcaactgtggtcggcctttgttctggccgcctgtgtggcgctggttatctgcctgattacattttttatgaccacatggattctgggacgtcagggaaaacagcagagtgaggatgatgttaccggaggacgccaacttaccgacaatccgaaagacgttgccagaatgctgaaaaaagacggaaaagcgtccgatatcctgattggcgatttgccaatcattaaggattcagagattcagaactttttgctccacgggacagtcagtaccggtaagtctgaaatcattcgccggctggctaactatgcccgtcagcgcggcgacatggtggtgatgtacgatcgttcctgtgagtttgtcaaaagctactacgacccgtccatcgataaaattctcaacccctgtgacgcgcggtgtgccgcatgggatttatggcgggaatgcctcaccctgccggattttgataatgcggcgaataccctgatcccgatgggcacgaaggaagatccgttctggcagggttccggacggaccatttttgctgaagcggcatacctgatgcgtaatgacagcgaccgcagctacagtaagctggttgacacgctgctttcaatcaagattgaaaaactgcgaacctacctgcgtgattccccggcggccaacctggtggaagaaaaaatcgagaagacggccatttccatccgggctgtgctgaccaactacgtaaaagccgtccgctatcttcaggggatcgagcgtaacggtgaaccgttcaccatccgtgactggatgcgtggtgtacgtgaagatcagaagaatggctggctgtttatttcttcaaacgctgacacacattcttccctgaagccggtgatttccatgtggctgtccattgccatccggggcctgctggcgatgggagagaaccgtaaccgtcgggtgtggttcttctgtgatgagttgcccacgctgcacaagctgcccgacctcgtggaaattgtcccggaagcccgtaaattcgggggctgctatgtctttggtattcagtccagtacacagatggaggatatctatggcgagaaagcggcggcaaccctgctggatgtgatgaacacaagggcctttttccgctcacccagctataagattgccgactatgtcgcccatgagattggtgaaaaagagatcctgaaagccagtgagcagtattcctatggtgccgatcccgttcgtgacggggtgtcgaccggtaaagagatggagcgtgtcacactggtcagctactccgatattcagtcactgcccgacctgacctgttatgtcacgctgcccggaccctatccggcagtgaagctggccctgaaataccaggaacgtcccaaagtggcgccggagtttattccccgggaaatgaatccggaggcggaagcccgtctgagcgccgttctggctgcaagggaagccgaggtacgtcagatgtccagcctgtttgaaccggatacagaagcggttgcgccgacagcagcagaagcgcaggctgaacagccgcaacagccgcaacagccgcaacagccgcaacagccgcaacagccgcaacagccgcaacagccgcaacagccgcaacagccgcaacagccacagcccacggttgtcagcgataaaaaatcagcagcggcgggtaccgccgtgaatacgcctgcaggcggtgtcggacaggaactgaaaatgaagccggaagacgaagagcagccactgccccccgggattaatgcgtccggtgaggtggtggacatggcggcgtatgagcgctggcggcaggagcaggaggtgaatactcagcagcagatgcaacggcgggaggaggtgaatatcaacgttcaccgtgggcacggaaaggatgaaccggagccgggagatgatttctgatggcggtatcagctccagtcctcagttctcagtccacccacacgttcaaactcccgggtgttgttcgtgacaacaatcagtccccggctgcgtgcgtgaccggcaatcatctgatcgaatggcccgacagggcgtccctgacgggcaagctctgccctgatctgccccgtatgggtggcggccggcgtgtcataatccagaacatcaagtcgggaaacaaacccctctatcacagcgagatttctttcgggcatctggcttttttcggcgccgtaaatcagctccatcagggtgaccgagctgatacacattctcccctggttcaggttaaaacgctccctgacgctggcaggtttgttttttatcgtgaaaatgcagatgttagtatccagcataaacttcagcatcagaatgattcccgttcctgcacagagggttgttcccggttatccataaaatcggcgctgacgttgttcccgtcgaaccattcatcccacgattctccggccggcgtgataattcgggttcgcccgacagcgataacttccacacgttttacattttccggcaaagccactgcttttggcagtctgaccgcctggctgcggttactgagaaatacgctggtttccatcatgtgcctccttacagggatatgtcttacgtatatccattatggtttttgtgatgggatatgtcaaagggatatacatttatgatgagtattgcgcaggtccggtcggcgggaagtgccgccggttattacagcgacagggataactactacgtgctgggcagcatggaagagcgctgggccggaaaaggcgcggagcagctggggttgcagggcaccgtcgataaggaggtgttcacccgggtactggaaggcagactgcccgacggggctgatctgagccggcagcaggatggcggcaacaaacaccgccccggctatgatctgaccttctctgcccccaaaagtgtttccctgatggccatgctggccggtgataaacgcctgactgaggcacacaaccaggcggtggatatcgctgtccgtcaggtggaggcgctggcctccaccagggtgatgacggacggacagtcagaaacggtgctcaccggtaatctggtgatggcgctgttcaatcatgacaccagtcgtgaccaggagccgcagttgcatacccatgctgtggtggtcaacgtcacgcagcatgacggggaatggaagaccctgagcagcgataaggtgggcaaaacgggatttatcgagaatgtctatgctaaccagatagccttcgggaagatttaccgcgcggtgctgaaagagaaggttgaagcgctgggctatgaaacggaagtggtcggtaagcacggtatgtgggagatgcccggtgtcccggtggaggccttttccagccgttcgcaggccatccgagaggcggtcggggaggatgcctcgctgaaatcccgggatgtggcggcgctggatacgcgtaaatccaaacagcatgtcgatccggaagtgaaaatggctgagtggatgcagaccctgaaagataccgggtttgatatcagcgcataccgtgagtctgcggacaggcgggcggaaatacaggcagcacagcctgttccgtcacaggagcagccggatattcagcaggcggtgacgcaggccattgccggattaagcgaccggaaggttcagtttacgtataccgacgtgctggccagaacggtcggcatgctgccgccggaagccggcgtgattgagaaagcccgggccgggattgatgaggccatcagccgcgagcagcttatccccctcgaccgggagaaaggactgttcacctccggtattcatgtgctcgatgagctgtctgtccgggcactcagcagcgatatcatgaagcagaaccgggtgaccgtccatccggagaagagcgtgccccgcacgggaagttacagcgacgcggtgagtgtcctggctcaggaccgcccgtcactggccattatcagtggtcagggcggtgctgccggtcagcgggagcgggtggcggaactgacgatgatggcccgggagcaggggcgtgaggtgcagattattgtcgctgaccgccgttcgcagacaaacctgaagcaggatgaacgtctgtccggtgagctgataaccgggcgtcgtcagttgcaggagggcatgttattttccccgggcagtaccgttattgtcgaccagggggaaaagctgtccctgaaggagactctgaccctgctggatggcgcggcgcgtcataacgtccaggtgctaattaccgacagcggtcagcgcaccggtaccggcagcgcgctgatggccatgaaggaggccggcgtgaacagttaccgctggcagggcaggcagcagaccccggcgaccgttatcagcgagccggaccggaatgtccgctatgcccggctggccggggattttgtggctgcggtgaaagccggggaagagagcgtggcacaggtcagcggcatgcgtgaacaggccatactggcggggatgatacgcagtgagctgaagacgcaggggatactcgggcagcaggacaccatgatgaccgccctgtcaccggtctggctggacagccggaaccgttacctgcgcgatatgtaccgtgaagggatggtgatggagcagtggaacccggagaaacggtcccatgaccggtatgtgattgaccgggtgaccgcacaaagtcacagtctgaccctgcgggatgcgcagggagagacgcagatggtgcggatttcagccctggacagcagttggtcactcttccgaccggagaagatgccggtggcagacggtgagcgtcttatggtgacgggaaaaattcccgggcttcgcgtctccgtcggcgaccggctgcaggtatctgcggtgaacgatggcgtgatgacggtgacggtacccggcagggctgaaccggcttccctgccggtgggggattccccgttcacggcgctgaagctggaaaacggctgggtggaaacacccgggcattccgtcagtgacagtgcgaaagtttttgcttccgtcacacagatggcgatggacaacgccaccctgaacagtctggcccgcagcggccgggatgtccggctgtattcctcactggatgagacccgcactgctgaaaaactctcccgtcacccgtcttttacggtcgtttctgagcagataaaggcgcgtgccggtgaggtatcgctggaaaccgccatcagccgccagaaagccgggcttcacacgccggcacagcaggccattcaccttgcccttccggtggtggaaagtaaaaacctggcattcagtcaggtggacctgctgacggaggcgaagtcgtttgctgcagagggaaccggttttgctgacctgggacgggaaattgatgcgcagataaaacggggcgatttactgtatgtggatgtggcaaaaggttatggcacagacctgctgatttcccgtgcgtcgtatgacgctgaaaagagtattctgcatcatatccttgagggcaaggaggcggtcacgccactgatggagagggtacccggcgaactcatggagactctgacatccggacagcgtgccgccacccgtatgatactcgaaacgaaagaccgtttcaccgtggtacagggttatgccggggtgggcaagaccacccagttccgggcggtgatgtcagcggtgaacctgctgccggagagtgagcgtccccgcgtcgtggggctgggaccgacccacagggcggtcggggagatgcgcagtgccggcgtggaagcacagacgctggcgtcctttctgcacgacacgcaactgcagcagcgcagcggtgaaacgccggatttcagcaacacgctgttcctccttgatgagagttcgatggtgggcaacaccgatatggcgcgggcatacgccctgattgcggccggtggtggtcgtgccgtggcgagcggtgacacggaccagctgcaggccatcgcacccggccagcctttccgcctgcagcagacgcgcagcgcggctgatgtggccatcatgaaggagattgtacgccagacaccggaactgcgggacgccgtgtacagcctgattaaccgggatgtgaataaggcactgtccgggcttgaaaacgtgaagccggttcaggttccccgcctgaagggggcatgggcgccggaaaactcggtgacggagttcagccgtctgcaggagcgggaactggcgaaagccgcacaggaggcggagaaaaagggcgaagcctttccggatgtgcccgtgacgctgtatgaggccattgtccgcgactataccggcagaacgccggaagcccgggagcagacgctgattgtcacgcatctgaatgaggaccgtcgggtgctgaacagcatgattcaggatgcgctggcgaaaccgggtgagcagcaggtcactgtccctgtactgaccaccgcgaatatccgtgacggggaactgcgccgtctgtccacctgggaggcgcatccgggggcgctggccctggtggataatgtgtatcaccggattgccggtatcagtaaggaggacgggctgattaccctggaagataaggcgggtaacacccgccttatttccccccgggaagcagcggcagagggcgtcacactatacaatccggaaactatccgggtgggggccggtgaccggatgcgtttcacgaagagtgacagggaacgcgggtatgtggccaacagcgtctggacggtgacggcggtttccggtgacagcgtcacgctgtcagacgggaaacagacccgcgtggtgcgtcccgggcaggacagggcagagcaacatattgacctggcgtatgccatcaccgcccacagtgcgcagggggccagtgagacgtttgccattgcgctggagggaaccgaagggggccggaaacagatggccggttttgagtcggcgtatgtggcgctgtcgcgtatgaagcagcatgtgcaggtgtacaccgacgaccgtcagggttgggttaaggccatcaacagtgcggagcaaaagggcacggcccatgacgtgctggagcctaaatcagagcgtgagatgatgaacgcagagcgcctgttcagcaccgcccgggaactgcgggacgtggccgccggccgtgccgtgctgcgcaacgccggactggcgcagggagacagccgggcgcgttttattgcaccggggcgcaagtatccgcagccgtatgtggcgctgccggcgtttgaccgtaacggtaaatccgccggtatctggctgaacccgctgacaacggatgacggtgccgggctgcggggattcaccggggaaggtcgggtgaaaggcagtgaagaggcgcagtttgtggccctgcagggcagtcgtaacggcgaaagcctgctggctggtagcatgcaggatggcgtccggattgcccgggagaaccccgacagcggcgtggtggtgcgaattgtcggtgacgggcgtccatggaatcccgtcgccattaccggcggcagggtgtggggcgatattcctgacagtaacgtgcagcccggcgcggggaacggggagccggtcacggcagagattctggcacagcggcaggcagaagaggcagtccgccgtgaaacagaacgccgtgcggatgagattgtccgtaaaatggctgaggacaaatctgacctgccggaggagaaaaccgcgcaggcggtcagggagattgccggccaggagcaggacagaatgaccccgcctgaacgggaacccccgctgccggagagtgtgctgcgcgaaccacaaagggagcgggagaccatccgggaagtggcgcgggaaaaccggggccgggagcggctgcagcagatggagcaggagatggtgcgtgacctgcagaaagagaaaacccctggcggggactgatacgggaagataaaccacgatgacgatggataacgccacacgtaacgattcgcgggcagtccgggtggatacccggctgcagcgactgctggcctggtcgccgggacagagagatctcatcaaaaccgtggcgctgctgctgatggtggctgaccatattaaccgtatcctgcacctgaaccaagagtggctgtttctggccgggcgcggggcgtttccgctgtttgccctggtgtgggggctgaacctgtcccagcatacgcatatccgccagtctgcgattaaccggctgtggggatgggcggttatcgcgcagtccggatattttctggcgggatttccgtggtatgaagggaatattctgtttgcctttgcggtgaccgcgcaggcgctgaagtggtgtgagcagcgctgcctgtttcactctgcggccgcgctgttactgctgacggcgtggatacccctgtccggaaccagctacggcgttgccggcgtgctggtgctggtcatctgttaccggctgtaccggaccacagatactgaagaacatctggcgcttgcggcctgcctagtggtggccgtccccgcgctgaatctggtcaccagtgatgccgcggcggtggcaggacttctggtgaccgggctgacggtatggcttgtttcgctgacaggcaaatcacggccccggttctggccggctgattttttcccggtattctacacctgccatctggctgccctgggcgttctggcgatgtgacgggtgtggtatctttggcggtatgagcaggatttggcaggggcagcatacagcatgactgagcagaaacgaccggtactgacactgaaacggaaaacggatggggaagcgccggcccgcagccgcaaaaccattattaacgtcaccacgcccccgaagtggaaggtgaagaaacagcagctggctgacagggctgtccgggaagcgtcactggcagaaaaaaaagcccgggcaagaaaagatctgtccatctacctgcgatttcagtcagtggaggaagcggtcagcacgctgaaaccctggtggccggggctgtttgacggcgacacgccccgtcttttcgcctgtggcgtgcgtgaggcgctgtttgaggacgcctccaggcgtggtatcccgctgtcacacaaaaagataatccgtgcgctgaaagcgattgcccgttctgaagcatatctcagcgcgatgaaagccggggcctgccgatatgacacggaagggtatgtgacggagcatattaccgtggaggaagaacagtacgcgctggcgcgactggcaaaggtccgggcgcagaacgccagaaaagcggaactccgcgcggtgctggcgcagacggtctgaaccggagaagcccagtataat
